United States Patent 10,233,495 (METHODS AND COMPOSITIONS FOR SCREENING AND TREATING DEVELOPMENTAL DISORDERS) - sequence listing, part 134

SEQ ID NO: 647 - DNA, 1080170 bp, Homo sapiens
  misc_feature (268869)..(418868): n is a, c, g, or t
gccagccactcacttcagtaggatctcctgggtctagagaaatagcaaatattcaggagctcatatatatccttggcctcacaaaaatgaaaaattctaaccctcctcatccttctataattctgaacttaaaccagctggagggcaaccctagtcactacctttatattacaagcaagttccagctggttccatcaacaaagatccatttactgttatatggaacaatttaattttctactaaaaactggatttttaacaactataaatggcaaacattacttattgcagaaatctgcaaaatgcaaagactaattttaataaaaattagtctttttaggcactttctgcaaatatacaaaccacaaaagagacattacacattattcagcacccctgctatactaagggaactttgaatatacgtaaatgtaagccaaagactcttttcggaaaacctccacattaaaaaaaaaaaaaaggagggtggttgcaaagcagtgtaaaaagggaaataaggtccctagaagggaatataattactatttcccattaaaagtaaaatataaagtaacattaaaagtaactataaaatagttaaggcataatttgcaggtcaccataacctgctgaaagctattctaaaatattatttcacaccatagcatgatgccagggatttgtttccaaagaatctggtgaacacagcaatggggataaaatagttcataagctgataaatgttggagagagggagtaggagggggttcattatcttattctaacatcatatatgtttgaaattgtctccattaaaatactttaaaaactactagacattattgatgaacaaatttaattttcatatcctaaaaacaaagaaagatgagtaccttccaatcttcgaatttttgctttcacagaaataacagtttcaaaaggtgaaactctcagctcaaaacatgttccagttaatgtttcaatgaagagctccatggtatcacagaaatgaagtctgtagtaaaatggtcccatgttatcatcattgaagaatggaggctcttttctgttatccattactttgacttttctagttcttctaaaatatgtcgcaggcaactgtattccagttctaggcaaaccaggtttgaagattggtaatatatattgttgttcatgttttgagttttgtacctaaaaaaacaagaatttttttaacaagcctatctgaaagttgtatttgtccataaagattttccgttaactgtggcccatatcaatcttccagacggccccagaattcactttagtgcttttaattatgtctaatcctgaacttttcacatttgtctctgaaatcactctcccatctagaccataagattattaagaatacgcatatttttgatattataatgtatcttactagagctcagcacagttatatatatagtacatgctcaacaaatacttttgttgttaagtgatatataagccaaactcaacaaacacatcagtatatttctgtaaggctttgaaaaatttattcatatccttttctaaaacatacaaattatgtcttctataccatataaagcataactttacaacgattgtacatttgactttttttttttttttgacagagtctcgctctgtcgccaggctggagtgcagtggcacaatctcggctcactgcaacctccgcctcccgggttcaagcaattctcctgcctcagcctcccaagaagctgggattacaggcacccaccaccatgcccagcagatttttgtatttttagtagagacggggtttcaccacgttggccaggatggtctcgatctcttcaccttgtgatccacccgcctcggcctcccaaagtgctgggattacaggcgtgagccaccatgcctactcctgttgtatatttgaatcatactggataaaaggaatgccaaccaccataataggttgcttaaaaatagtactcactaggctgggggctgtggctcatgcctgtaatcccagcactttgggaggccgagatggcagatcatgatgaggtcaggagatcgagaccatcctggctaacatggtgagacccaatctctactaaaaatacaagaaaaaaatgagctgggcgtggcggtgtctgcctgtagtcccagctacttgggaggctgaggcaggagaatggcgtgaacccgggaggcagagcttgcggtgagccgagattgcgccacaacaccccagcctgggcaacagagcaagactctggtctcaaaaacaaaaaaaagtagtactcactaaatcatcaacggtttccagaggatattatagcattcagatgacattagaattggtaataagtattagacaatctctgctcacatacatacaatggctaataagtatgagtggtaagcccaacaaatagaagtagtaaactaaatgacaagtatagaactaggagcacaaaaatgatcaaattgctattgctattaatcgtgaaaactctatacaggggggccttgaacttaaactaggacaaatgatacacatctttctggtgaggtggttaaacctttttaaaaatagctttattgagggccaggcacagtggctcacacctgtaatcccagcacgttgggaggccgaggtgggcggatcacctgaggtcaggagttcgagaccagcctggccaaaatggcgaaaccccatctctaccaaaaaatacaaaaattagccaggaatggtggcgcacacctgtagtcccagctactcgggaggctgaggcaggagaaccgcttgagtccaggaggcagaggttgcagtgagccaagattgcaccactgcactccaacctgggtgacagagcaagactccatcattaaataagaaaaaaaaagctttattgaaatataattcacatgccataaaattcactcatttaaagcctaaaattcactggtttttatgatgtacacagagttgtgcaacaatcaccacatttgctttagaaaattttcattacctctaaaaggaaccccataccctgtaaccaacactcccaaattcccccagtcccccactcaaccctaggcaaccactaatctactttctatctccaaattggtctattctggacatttcacataaatagaatcatatatgatttttttgtgactggcttctttcacttagcataatgttttcaaagttcatcatgttctaggatatatcagtatttcactcctttttattgctgaataatagtcccctgtagcaatatatctcatgttgtttatccatccatcagttgatgagcatttgagtcgtttccaattttgggctgttacatatagtgctaagatgaacattcaactgcaagtttttgtgtaaacatatgttttcctttctctttgaagtagctttgctagataatgtggtaactcttatgtttggcaatttgtggaactaccaaactgttttctaaatggtatggatcattttatagtcccatcaacaatgaatgagggtgccaatttctccacacccttgacaatacttgtttctgtccttttgattaaagctatcctagtgggtgtgaagtagtatctcactgtggttgacttccatttctttaaaaactaatgatattgtgcatcttttttatgtgattattggccatttgcatacattctttggagaaatgcctattcatatactttgtctattttttaattggattttttattgagttgtatgagtttttatattacatattctagataaaaacacttaacagatatatgaatggtaaatattttctctcattttgtgggttgtcttttgatagtatcttttgaaacacaaaggtttttaattttgttaaactctaatttggctatttttcttttatcatacttaaaaagcttggcttaacccaaggtaataaagattgacttatatatgtttctaaaaattgtagttttagctcttatgtttaggtgtactgtccaatttcaatttagttttgtgtatggtgtgaggtagagtctaactttattcttttgcatgtggataaccagttgttccagtatcatttgtcagaattaccattcattcccaattgaattgtcttggatccttgttaaaaaccaatttactgtaaatgtgaaggtttatttccagactctttattctgttgatctacctatgccagtaccaccacatcttaattaatgtagctttgtagtaagttctgaaatcaggaagtgtgaggcctccaatttgttctttttagattgttggctattctggactccttgaattgccatatgaattttaagtatgcccattttgcaaaaatgtcagctgggattttgacagggattgtattaagtctgtagatttggagagtactgcaatcttaatactaagtcttctaatccataaatacatactatttttcagtttatatctaatttatttcaatgttttataatttttaaagcacaagttttgttctcttttattaaatttattcctaagtattttattcctttaaatgctattacaaatggaatcactgtcttatttacagattgctcattgctggtttatagaaacacaaccgattttaatatcttgatcctgtacactgcaactgtgctgaactgtttatttcgttcatttagttatttaaatcttcctaaacgctctctataaaagctctatatacaagatcatgtcatttacaaatagagttttacttctccctttctaatctatatgctcttttctttctttttttttttttttttttttttggagggggtgaaagtcccactctgttgcccgggctgaagtgaaatggcacgatctccgcttattgtaacctccgcctcccgagttcaagcgattcgcctgtctcagcttcccaaatagctgggattacaggcacctgccaccacaccaggcaaatttttgtatttttagtagagacaaggttttaccaagttggccaggctggtctcgaactgctgacctcaggtgacccacccaccctggcctcccaaagagctgggattacaggcctgagccactgcactgggcttatttccctttcttgcctaattgccctgctctggaaccttcagtacaagattgaataaaagtggtgagactggacatccttgtctaattcttgattgtagaaggaaaccattgagtctttaggtataatgttaaccgtggggttttcatagattaccaatataaggttgacgagcttcccttctattcctgctttaggtgggttttctttttaatcatgaaggggtgccaattttatcaaacgcttttttcattgtctattgaaataatcatttggttttctttacttttttattcacatattacattactttttatgtgtcaaatcaatcttgcattactggggtaaatcccatttgtacctggtatgtaatcctttacatatgttgatggatttgatctgaaaatatttcctcaggatttctgtgtctataatcacaagagatgatgatctgtagttttcattatgtctgtcaggatttggtatcagggtaatattggccttagccaaactaagcttcgtaagtgaaggagaaataaaatcctttacagacaagcaaatgctgagagattttgtcaccaccaggcctgccttacaagagctcctgaaggaaacactaaacatggaaaggaacaaccggtaccagccactgcaaaaacatgccaaatggtaaagaccattgatgctgtgaagaaactgcaacaattaatgggcaaaataaccagctaacatcataaagacaggatcaaattcacacataacaatattagccttacatgtgagtgggctaaatgccccaattaaaagacattttaatgtctggcaaattcttctcagcaccacatcgcacttattccaaagttgaccacatagctggaagtaaagcactccttagcaaatgtaaaacaacagaaatcacaacaaactgtctctcagaccacagtgcaatcaaattataactcaggattaagaaactcactcaaaactgcacaactacatggaaactgaacaacctgctcctgaatgactactgggtaaataacgaaatgaaggcagaaataaagatgttctttgaaaccaatgagaacaaagacacaacgcaccagaatctctgggacacatttaaagcagtgtgtacagggaaatttatagcactaaatgcccacaagagaaagcaggaaagatctaaaattgacaccctaaaatcacaattaaaagaactagagaagcaagagcaaacaaattcaaaagctagcaggaggcaagaaataactaagatcagagcagaactgaaggaaatagagacacaaaaatcccttcaaaaaatcaatgaatctgagagctggttttttgaaaagatcaacaaaattgatagattgttagtaagactaaagaatcaaatagatgcaataaaaaaagataaaggggatatcaccagcgatcccacagaaatacaaactaccatcagagaataccataaacacctctacacaaataaactggaaaatctagaagaaattgataaattcctggacacatataccttcccaggactaaaccaggaagaagtggaatctctgaagaaaccaataacaggctctgaaattgaggcaataattaatagcctaccaacaaaaaaagtccaggtccagatggattcacagccaaattctaccaggggtacaaagaggagctggtaccattccttctgaaactattccaatcaatagaaaaagagggaatcctccctaactcattttatgaggccagcatcatcctgataccaaagcctggcagacacacaacaaaaaaagagaattttagaccagtatccctgatgaacatctatgcgaaaatcctcaataaaatactggcacaccgaatccagcagcacatcaaaaagcttatccactatgatcaagtcggcctcatccctgggatgcaaggctggttcaatacaggcaaatcaataaatataatccatcacataaacagagccaatgacaaaaaccacatgattatcttaatagatgcagaaaaggcctttgacaaaatccaacagctcttcatgctaaaaactcttaataaactaggtattgatggaacgtatctcaaaataataagagctatttatgacaaactcacagccaatatcatagtgaatgggcaaaaactggaagcattccctttgaaaaccggcacaagacagggatgccctctctcaccactcctatttaacacagtgttggaagttctggccagagcaatcagacaggagacagaaataaaggatattcaattaggaaaagaggaagtcaaattgtccctgtttgcagatgacatgattatacatttagaaaaccccatcgtcccaacccaaaatctccttaagctgataaacaacttaagcaaagtctcagggtacaaaatcaatgtgcaaaaatcacaactatctgattttttttttttttttttgagacggagtttcacttttgttgcccaggctggagtgcaatggtgtgatcttggctcaccacaacctccgcctcccagattcaagtgattctcctgcctcagcctccctagtagctgggattacaggcatgtgccaccacgcccggctaatttttttgcatttttagtagagatttctcccaacaggggtttctccatgttcgtcaggctggtctcaaactctcaacctcaggtgatccgcctgcctcggcctcccaaagtgctgggattacaggcgtaagccactgtgcccagcctacaaccatctttgacaaacctgacaaaaacaagacgtagggaaatgattccctatttaataaatggtgctgggaaaactggctagccatatgtagaaagctgaaactggatcccttccttacaccttatacaaaaattaattcaagatggattaaagacttaaatgttagacctgaaaccataaaaaccctagaagaaaacctaggcaataccattcaggacataggcatgagcacggacttcatgactaaaacaccaaaagcaatggcaacaaaagccaaaatagacaaatgggatctaattaaactaaagagcttctgcacagcaaaagaaactaccatcagagtgaacaggcaacctacagaatgggaaaaaaattttgcaatctacccatctgacagagggctaatatccagaatctacaaagaacttagacaaattttcaagaaaaaaacaaccgcatcaaaaagtgggcaaaggatatgaacagacagttctcaaaagaagatatttatgcagccaacagacacatgaaaaaacactcatcatcactggtcatcagaaaaatgcaaatcaaaaccacagtgagataccatctcacaccagttagaatggcgatcattagaaagttaggaaacaacagatgctggagaggatgtgtagaaataggaacacttttacactgttggtgggactgtaaattagttcaaccgttgtggaaaacagtgtggcaattcctcaaggatctagaactagaaataccatttgacccagcgatcccattactgggtatatacccaaaggattataaatcatgccactataaagacacatgcacacgtatgtttactgtggcacaattcacaacagcaaagacttggaaccaacccaaatgtccatcagtgatagagtggattaagaatatgtggcacatatacaccatggaatactatgcagccataaaaaaaggatgagttcatgtcctttgcatggacatggatgaagctggaaaccatcattctcagcaaactgtcacaaggacagaaaaccaaacaccgccatgttctcactcatagatgggaactcaacaatgagaacacttggacacagggaggggaacatcacacactggggcctgtcgtggggagtgagatggggggagggatagcattaagagaaatacgcaatataaatgacgagttagtcggtgcagaaaaccaacatggcacatgtatagctatgtaccaaacctgcacgttgtgcacatgtaccctagaacttaaaaaaaaaaaaaaaatcaattcccaaagcatttctctcatttcttctgaaaagtttctaaaaacacaactccaaggatgaaatggaagttaaaggtaaacaggcaatagcgctgaatacgtaatttcagtaactcagaattttctccaacctctgctctaaagaagcttagctacagaagagcagttacctttgaaacattttccccaacataaagatatccggaatgtgaagctgccattaaaactgtgacacagatctacatttactgatacatcaaaacatccctaaagttcgaaatacgagctacagaatcacatcaaccgcctaacttgtctgtagcctaaactctagtccggagttcatctgcaagcggaattgggaagtatttcagagccagcatctcctcgcgccatccaggtacctacacacttgaggccaccgagtcacctgcgcagccgttgctcctccaagaccaatccgggctccccagacccaccggcctgaatctggaggacagcagtccgcgtgacaacagcgactcggagatcagcacccgtcgggaaagccgcgtacccgttgaagctggcgtcacgcccaaaggaacaaacgccagagcgtgtgtcctgggcaaaggcggcccgccgctccggtccccgggcagcagcggccggcgtcaggccgcaaggcgaggggcggggacaggactctacccggcagcccagcgccgagcgcccgcgccactccggccttgcgccattccggccccacgacggccggcggcggcagcgcggctgggctcagcggctcgcagcccgggcgccccccctgccggccgctcgctagctcagcctcacccgcagtcttgtccgctggctcgctcgcccgcctacaggtcgacagggcccaacgacccggcgagcaacttcacggaaggcactggccgacaacgctccgctgccgccgcgccccgcccctttgtgacaccacctaccaatcgctggacggcgctttcgctgccctccaatcagcgcgggcgggggcaggcctggcccccggacgtgggcggttgccggggcgccagggccctggggccttcttggcattcgctggaggttgtgagttacgaggcccggatgttgatcttttattactagcaacactggacccctgactcgtgcccacgcgggcgtctggagggcagccgcatggcctgctgggaacggcggggttgaagccggagccgccctccgtgagacccaccggggatcctcttccaggcgcctgatttgctggagataggcgatacaggcagacgctgtccagtcggtggcctctccagagtgaggggcgctcctggtgcgtttgggccggcctgtcctaacaaatctgctttaggcttcaccgtcccctaatgtttctggcctcaattgcctcatctggaaaatgggggcattaccgtgcctgcttgaagacaaaggcgaaaacagataactttctgtagtcctcatacaatttactgagaactgtaggccaggcaatggagtaggcaccctgggctcaaatcccagcgttgggtaagcccagccacacctcctgctccagtttccaagctgctgagctgcggtgtaaacagtaactggcttcaagccaacacctgcctttcaacctaacatgggagcccactgcctcgttccgttccccctaccgattttccaactccgtgaacctccttcactaagtgggttactcagctgacaaagaatgtcatctcactcccactgcgggttcactcatcctcgacttctggctcagaggagccagtctaatatgaaactaaacatctaatctgtgtctcctgtcctctctcattcttctgagaccctacccaccaacttatctccacagttcaacgaactattgagcatacactgggggagtatggtgaggcactgggcattgattcaccagtctcgccgttggttccttctgaaactccacatatgcttaatgctaaatagattggagacctttgaggacagagctatgatggtaatcatctttgcattcctgagcctagaatagggcctgtgatggagacttactgagtaaaaaccttagcgtttctcacccttgcctgcccacttcattcacactggagaattgacagcatggaccgtggagtcaggcaggtgtgtttaaagccttgcctcccaataccagaagctccattacctggccaagtcattcattctttacaacatcatcatcattatcatctgccattcttcaagtgccagatagttgataagggtctttacgtattctctccccatcacaatcctgcaaagttggtagtgaaatccctcgtctacaaaggagtaaacaaaagccaattaaagtagaacaatttacctataatcaaacagctctatgtcggaaagccatatttaaactaggacacaatacaaaaatccaaccttgttccattattccacattgcttccagattttagctttatctgtaaaattagtgttactacattacctatctgatagaccatggagactgaataaaatagcattaaaagttgttaccataggaacttttttttaacgtaagttctctctccctttcaagcctctcaaaatagcagcttgcgtattttctaaacctgttgtctcctgaatcccctgaaaccaatcctactgattgatgagtagatttagttgttccaaaagaaaatcatcgtatttaacaaatgctgactctgaccgacattgggtactacagcaagaaactatgtgcacaaataacctacggacagaaggaagatgcataaaatgaataggggaaaggagtggccaactagcaagtgccctcatctgtcatcacgtcactctcacagcagacttgggcaaatggttgacctgtgggagctgaacaaaatctttgactctgggtatgagtaattccctgtctgatcttacagtgcccaaggaagaagtcagtagctccaggatcgctgagaccaacctgggcggcctacaagactgcaccatggtgacaggctgaatagtcagcagcaagacgacagagcaccaaaaaacacagactagaatggggtcagccatccaggtggctagtggctactgcctttgacgatgcagataaagaaaattttcattcctgcagagttctatggggcagtgctgctctagaggctgacatttctatcctcagcacttcccccggctattacctaggttcattctgctgcttccacaaggcaagaatggaacagaatgccttagagcaatggtcagcgaactgtttatgtaaaggggcagggccaggcgcagtggctcacgcctgttatccccgcactttgggaggccgaggcaggtggatcacgaggtcaggagttcaagaccaacctggccaacatggtgaaaccccaactctactaaaaatacaaaaattagctgggtgtgatggcaggcgcctgtaatcccagctactcgggaggctgaggcaggagcatcgcttcaacccaggaaatagaggttgcagtgagccaagatcacatgactgcactccagcctgggtgacagagcaagactccgtctcaaaaaaataaataaaaggggcagatagaaaacatctgaggctctgtgagccatccggtctcgtcataattactcaactcttacattggaggtagggtgaaagcaacaatagaaagtaagtaaatcaatgaatgtggttgtgttccaataaaactttattaacaagatcagacagtgggggggggggggtagcatagtttgccaaacgaaaatccaataaaaatttattaaagatttaaatgtggccaagcgtggtggctcatgactgtaatcccagcactttgggaagcggaggcgggtggatcacaaggtcaggaggtcgagaacatcctggccaacatggcaaaaccctgtctctactaaaagcacaaaaattagctgggcgtggtagcgcgtgcctatagtcccagctactcaggaggctaaggcaggagaatcacttgaacccgggaggcgaaggctgcagtgagtcgagatcgcaccactgcactccagcctgggcaacagagcgagactctgtctccaaaaaaaaaaaaatcaaaaaacaacatttaagtgtaagacctgaaatgagaaaacttttcttttaggtttttgtctagaagtttctaggtattgatcttgacaataatttacagaatatgtcacaaaagtggagacatgaaaagccaaactaaacatgggacaatgccaaattgaaaaccttcacagcaaagaaaccaatgaacaaattaaaaagctttttaacaattatccaaaatacctaaagaacttgtattaataaataggaaaaaaaactgaaacaaaacagaaaagcatcaaaaagcttaaaaataagcagatttggccgggcacggtggctcatgcctgtaatcccagcactttaggaggccgaggtggacggataacctgaggtcgggagttcgagaccagcctgaccaacatggagaaaccctatctctactaaaaatacaaaattagccgggcatggtggcacatacctgtaatcccagctactagggaggctgaggcagaagaatctcttgagcccgggaggcggaggttgtggtgagccaagatcatgccaccagtctgggcaacaagagctaaactccgtctcaaaaaaaaaaaaaaaaaaacatgttcagcaaggttgaagcatcaaaggttaatagccagaatcatttatcaattgtatttctacacatctgcaagacacaatctgaaaatgaaattagaaaaacaacttcattgggcaacaagagcaaaacttcatctcaaaaaaaaagaaaaaaaaaatagtaatctacaatgtcatttcctgttcaagcttgacttctacctttactttctgatatggttttgccatgtccccccacccacatctcatcatgaattataatccccataatcctgatgtgtcgagggaggggcctagggggaggtgattggatcacgggggcagttatcctcatgctgttcttgtgatattcagtaagtcctcatgagatcttatagggttttgttttgttttgttttttggatggagtcttgctctgtcacccagactgcagtaccatggcgcgatcttggctcactgcagcctctgcctcctgggttccagtgattctcctgcctcagcctcctgagtagctgggattacgggcatgcgccaccacacccagctaatttttgtatttttagtagagacgggatttcactaagttagctaggctggtctcgaactcctgacctcagttgatccacctgctttggcctcccaaagtaccagggttacaagtgtgagccaccaagcccagctgagatctgatggttttacacatgtttgacagttgctccttcacatgttcccactctctgtgcggccaccatgtaagtcggacctggttccccttctgccatgattgtaagtttcctgaagcctacccagccatgcgaaactgtgaatcaattaaacctgtttcctttataaattatccaacctcaggtatttctttatatcagtgtgaaacagactaatgtgctttccgataatcatgcttcaggaattggggaattcagactacctgggatcaaattgtggccccaaccttagcagccatgtgaccttggggaggttacttaccttctccatctcaactccttcagtaaaatctgtaaaatgacattgtttctgagggttaaatgagcatagcacagtgtcaggcacacactacttgccagatgtcgagtattcatctttattgaaataggactgtggtaagccactttatggctctcgattttgtatgagaaaatcatgcttagtgccttgttagtaaaagaaagaaaacctgaaagtccctgccacggaaggaagaaatagcggggagaaaagggagttggtaagtttcagcatttcagagcttggagagggacaagttaggtttccattttatggagaaggaggtggaggcaggatgggtcctaaggtgtcattcaaaacacacagccataactctttattgagagtagcgctagggccccagggattgctgtggtcaagttgcggacaaaaatgaccactcgttggaagacaggagaggagtgtttagttacaaaagcagtcaacaattcaggtgtatctatattcagacagcaaataaaagttgttcaacttggttgctaatgggacccactctactgaggctttgtatagaactcatagaggaagatggcttcaaggaatgaactaccctgtgcttttcttaggactaaaatctcaggaagctggtgatgaatgaaaaccttagtcccactggcactgcacgaggggccaggagagcagcagcatcataagccgcagggtggggcagccaaggcaggggcattctgagctgttggggaggggtggcaggcagggtggggcactgtgagctgtcggggagggcattgtgaagtgtggggtggggcattgtgtgccacatgcctgggctcccacctggggccagtgggcttcagtctgtaggtgactacagaaggaggaggagctccgtctgttctctcttcaggcagttgttgtgtctctcagcacttgttgggttcacaacctattaaataagccggctggtcttcaccctcccagacaagtcaactcaggggaggcagcagggtgcgggccttggccagggccagggccagggccagggccagggctggtgcccggggccgcgctgtgaggtgggcaggcgaggagcgggaagaccatctctgcaagtgcagcatagcctcggcctaggacagcgggagtgcgtggccaaagctgtgagcagaggcacaggtggtggcagacagtagaggcaccccatggggaacatactgacctgtcgtgtgcaccctagcgtcagcctcgagtttgaccagcaacaggggtcggtgtgtccctctgaatctgagatctatgaggcagtagctggggacaggatggcaggagcgcccatggctgctgctgtgcagcctgctgaggtgactgttgaagttggtgaggacctccacatgcaccacgttcgtgaccgggagatgcctgaaggtaaggaggtgataggtgccatctaccctcggtttgcctctggctgctgctgtccccaaggttccctttgaggcatcccccactttgagctcctttctgcttgtagccagcttttccgggggctggccaggaacaaaagctggctctgccttgaattcccaccccttagtctttccccaccaagtccagtcagtttcttttcgcctcccctcccaatcgcccagttcttgctctctcacctcattctcccaggctggcatgggaccatttatttatggctcttgtcgaataagcagcagttgaataaatgagttgataaatttttataaatgattacatcttttttcttttctccctctatacatatagctttggagtttaacctttctgccaatccagaggcaagcacaatattccagaggaactctcaaacagatggtgagacaacagtgtctgtagctctgtttattatcctgtgggactttgtttaggcttctttgagctattctcttccttttctcaataaaaactcaaatatcccaacttttcagtacccatcttattttttctttgtacctatccagatggtacctaagtgaaggaaccaggtaagtgcctaattgtttcctttgttaaagtagtcaaatctcaggacagttcctattcaaatatttggggatttcttatttaaaatcagaatggagtttgccacgggagaggctatatggtattcttaatgggctgctttaagtcaccttgatagaagctgcttagtttcttctaactgtaatttgaacacagaaggaaaaagaaaaaaggagagtgcttaaaataattgtgaaaggtgtgaaatgtcacagccggggctgcagaaaaatggttgtgtgtgtgtgtttggggtttctcaaaggagtttacctatgaggctctgattactttaaaattcttactttaacagaaaatgtgtctccagatttattctggtgacttaacagactttatttacctccttgttctaaaagagaggtggggattggttcatggtcaaaactttcaaaagacatgaaacgtcaatgtagactttcaatgtgtaatataaagattgcaggttaaaatgtcagaccttccctgtaagagtgtttgttgccatggctccccctttgtcccttcccctcctgacaatagcatcttgttcaaagataagaaagttacagttttggctgggcttggtggctcacgcctgtaatcccagcactttgggaggccgtggcaggcggatcacctgaggtcaggagttccagaccagcctggccaacatggtgaaacgctgtctctactaaaaaaaaaatacaaaaattagctgggcgtagtggcacatgactgtagttccagctactcacaaggctgaggcaggagaattgcttggacctgggaggtggaggttgcagtgagcagagatcacgccaatgcactccagcctgggtgacagagcgagactccgtctcacaaaaaaaaaaaaggaaagaaagttggagttttttagtctctacactgctggcagaggcaggggatgggagccggtagaaaagagaaaacaattagttggtttgcctctaaaattttgcaaagagatgaatctaagtaaaagtaattctgggtaataatatggttcttgaataaaaactgaaattttcaaaatagaaaacattgcatcataaacatattacatccagtaggcttattggtttcatttaaatgccagagatttcatcactgtagaggaaatgtcttatagctcttctatttaaactttggttgcgctcttaatttttaaagaggtaggataattaagactcattatgagtgtgactttgtaacttggaagtactatcttcacatttcaagatatttaaggattgctttagaataaacaaatgtattatgtgaattaattgattgtacctttatacacaaagcatgtaagtacttgtgtaaacttatactctgcttggtgatgttcggaaagcctgatggatgttacacaccagttagtagatgggtagtgttggatgagagcccaaaaatggctctttattgtcattctttaggattacaacacagtttatgtatgtctcacttggccctttccaatacaaataaggcctgtgtatgttctccctatgtgttgctaatgaagaaatgaaaacttagagatatcacatgactatggaagacagctactcaagagaactaaggttctgtgtcctcagaatgaaatggaagtgacagatatgatgaatttactttttaaaaattttaaaaactctagaatacctcttatattttgcctataaaatagacctgtcttttaaaacttactgccatcttgatttattttatgcaaagttgattttacacaactcaaagccaaaatttacctcttcttttttttttttttttaaataaaggagggtgtcattatgttactcatgctggcctcaacttcctgacctgggttcaagtgattttcccatctcagcctcctgagtagctgggactacaagcatgtgccatcttgcctggctctgtcttgtgtctatacgctcatttcaatggataagaatcaaagtagagatagtgaaatagcctaaatgcagcagccgaataaacgagttgataaatttttatcaatgattacatctttttttcttttcttcctctatgcatatagctttggagtttaacccttctgccaatccagaggcaagcacaatattccagaggaactctcaaacagatggtgagacgacattgttttttccgccaagagaaagaataaaagctcttgtttgatcaggttatagaaagtatttagaaaaactcatattggtttaaaattttcatcttttcacatgttcccttgtcttattttaatatgtgatatactttcctttagttgttatgatgttagtgaaaacgtgtaacctttttgtttatacattttgccatctttttatcaacacaattaatttgtgatgtgatggaggagtcatggatttctctttataattcttggatttatctttatttataattaatggatttatctttatttataatcccttttcccttgctccaaaaagtacattttaaagatgaatgatagaacttaggcttcagcttggttttcatttaaacaaattaaaaaacgtagttgtttatcatcagggattgaatctgtgatttgggcctcctcttacacagtcctctgaccacattcatttaccacatccaagttcatgctactcaaaagttttaggttattaactttttcatttgatataatgtaaatttaaacatgccttactcctgcttatttcccttaatgttatgttaaatcctcatttatttgccaacaagccatacacagccaagttttccagttgacttaaacagcaagaacacaagtgagggttctataataatgtgcgaagtaatgcagcacagtaaaacacgggagtttgtaacctttgtttttatagtttgagtagactttgcccatcttgagtcagttatttctggttagaatttgtcttcattttttacattactataaagagatacctaaggctgggtgatttataacaaaaagaggtttaattggctcaaagattttcaggctgtacaaacatggctttaacatctgcttctggtgagggcctcagcaaacttacaatcatgataaaaggcaaaggggaagcaggtggttccacaccgtgaaagagggaggagagaggggaagggggaaggtaccacactctttttttttttttttttgaaatggagtctcactctgttgcccaggctggagtgcaatggcacgatcttggctcactacaacctccatctcccaggttcaagcaattctcctgcctcagcctcccgagtagttgggactatagttgggcaccataacacctagctaatttctgtatttttggtagagacagggtttcaccatgttggccaggctggtctgaaactcctgacctcaagtgatctacccgcttcagcctcccaaagtgctgggattacaggcttcagccaccgcacctggccagtaccacagtcttttaaattaccataatgagaatgtgcttattaccatggggatgggaccaagccattcataaggaatccactgccattacccaaacgcctcccactaggccctgtctccaacattaagggtcacatgttaacatgagacttggaggggcaacatatccaaaacatatcagaattgtatttcccagttccttccagaggcatgggcttctcacacctagagagcatggaagcagtaaaagaaaagctattccatgtccctcactcttcagtggtagtaacttttgcctacaaggccctcccagcatcaaaggcagaggcagtgtaggaaacaaagcatggcccaagtccctcttggggcttttattattctggcctctttttagggaaaaaaaaatgattttttgtgctgcagacaccatgtccaattaggtttgtatacttattttaacatcaaaatttaggccaggctctgtggcttacacctgtaatcccaactctttgggaggttgaggtgggtggatcacgaggttaggagatcaagaccatcctggttaacacagtgtaactctgtctctactaaaaatacaaaaaacaattagctaggcatggtggcacgtgcctgtggtcccagctagtccggaggctaaggctgaagaattgcttgaacctgggaggcagaggttgcagtgcgctgagatcccgccactgcactcgagcctaggtgacagagtgagactccatctcaaaaaagaaaacaaatttaagataggttactttccagttgtgtaaagaccattttttaattttgttttgtttttagtgacatattagtagataaccactaagtgtggttcaagatgcttacagggtttctgttgcatctagagataggtgtctggtcaggaagtagtttttagaactgttagctcttagagtctgataattaaagtaagctatgtgtaaatgcagaatgagagaatactaatggatcatggctcatatatgcaacagttaaactttttattagctaaatttttcatctggcctaatttttttgcccttttcttttgtacatgaggattctttcatttgtatgtaatagaaacaaaaagtaaactaaatgaaaatctaagtttttagatttgacttatgaaattaatcatgccagataatttaaattatatgttattgaaaattttttttaatggaattttgtctcatttttcataggagtaatcagtaagatgttaacaactacttttattttatggtatttgtatcagaagtgaccagtttttttttttttattcttagttgtagaaataagaagaagcaactgtacaaaccatgtaagtaaacactcaaatagttaagaaattgatagtttgacataaatggatgtctctcttgatttctttaaattacaatgtggacctggtggtggtagcatggacctctttttgtggattttctaaatctcttctattttcctgagtattaaatttatccaggaaagtgcttagtttagcgtgtccaccttttaaagatttctgacatttaagttaaatttcaatagtccggttcaaaagatctgccttaaggctgggcatggtggctaatgtctgtaatcacaacactttaggaggccgaggcaggctgatcatctgaggtcaggagtttgagacaaccctgaccaacatggtgaaattctgtatctactaaaaatacaaaagtagctgggcgtggtggtgcatgcctgtaatctcagctactcaggaggctgaggcaggagaatcacttgaacccaggaggcggaggttgcagtgagccaagatcgcgccattgcactccagcctggacgacagagcgaaactctgtctcaaaaaaaaaaaaaaaattgccttaaatatttaatcttatttttaatgaaagaacaaaaatagaatagctaagttaattgccagcactgtctattgactttctgtcacagcaggtaaaagcataccttccccgctacaccatgatcttatgtttctccctgtgttttttccaattgtagcacactttttaattaaatcagtaatatttacatgattatgactctgcaaatattattcactgctaagtcatatggtgttttcactgtgcctctgcattccatgtccttcatcctgtctctgaaacagttctgaaatctgagcacttctgcaattctcctggatcttcttttttcctagcctacgttagtttatctatccaaatatcgttaagtagcctctgggtgctctgtttgctttcacatccattattttttagcatgaagctaattttctgactatattcatttgcctgttttctaacagctgttttcccccaagtattgtagcatttatcacatgcctttcaaagatattttccatctgcgaaaacacatctgttcctttttatgtttgtgtggggggcaactttctttggccttttgtcatcctagttcaatatagcgtgggtttccctagatatgctcaatgtctgcttttctgggctaactctttaaagtcttttggtatctcacgtaactgctgtcttgtgtgggatcgcctgagtcctagattctgtgtttccttctgtcctgttatcgtctctagttgtacttgaacacattttcctgtgtggagatgttaaaatccctcctctttgatagagagtacacctctaggttgaatctaaatgttgtggttctgaagacattttgcagttgtgctcttattacagtgttgttcttgaatctattgccagtgtgtgatacgttatttacaaccaggttttagttatctgcggaagctttttggaatctctctctctaaggttctgaaattttataacagcttgttggggatcttttcattttattgaggctactaaacctgcagactatctcttcttgagaatttttttttattttctctgttacttttttactgatagtcttgttattcagatgctaggctgcttagaccaatacgcctgcattgatttttaattttttcccttgtatttttttcagtttgtctttttattctagttctgggatattctgtgactttatcctctactatttctattgaattttatattttttgagagtgttttaagatttttttttaaagttttgctcctgattttgactggtcctatcaattccttttttctattgttttgatctcttttcttggaggcttccctccaatgtgtggtggtccctggcctgctttatttggaagcaggatttctgttaactgatagcactcagtgtgaggccttagaagcctgactagcttttcatttgggagacctcagtgtattatctggggatctttattgaagacatttcagtttcttctgagaaggatctcccaattttctgcctggaaagtaaaagcaggcctggaaaggaaaagcagagttagcgaagaaagttggagttccatttttggtgtacagttttctttatatctcaggtttaagccatggtatctctgagccagaaattctcaggtttgatatatccagagaacacacatctaagtttcttgtcagatggaaggacaggtggacttggggctctagttagagatttgcaactgaacttgctggctttttttttttttttcacattttaccctactttccaaagtgccatttgcctgtaagttcacaacctgcctttagttctgcaagacaaactggctcgcttctgttccagtcactttctgtaggcaccaaagttgtgtttctgtgttatttaccactcctttatctactttttatgtctcagcatttattagaaattatctctgtcaaccttctgtgctggtcatgggtgtaacctttattttatgactgatgaggcttccggagggagacgaaataaatttgtggtcaatctattatatttaatccaaatttaggacctgtgtttaaatcaaagtctaatttgagtataattaatgatattaagccagagaattttttaaattaatgtatctataataagcatattacacttttctcctaaggccttgtttaatattttcattcaaagtttatccactgccatatacttcccattacttcacaacatagatggagctgttttcctgaatgcccaaaatgttagaaatatttaagttaattaagatttgttcatttttagcctggtcaacatagcaagacctcatgtctacaaaaaggttaaataaaaaattagccaggcctggtggcatgcacctttcgtattacctactcaggaggttgaggcagaggatcgcttgagctcaggagtttgaggctgcagttaactataattgcaccactgcactccagcctgggcaacaaagggagaccctgtctcggaaaaaggaaaaaagttactaattctttaaaaacctatctaaaatttgtcctgcccaaaaggagagtgaaaaatatgaactttagtctttgttttattttatgtttgctgagaaaaatgctgtactttatttatttatttattatttccataggtttctgggggaacaggtggcatttggtgacatgactaagttctttagtgatgatttgtgagatttaggtgcacccatcacctgagcagtatccgctgaacccaatttgtagtcttttatccctcaccctcctcccagcctttccccgaagtccccaaagtccattgtatcattcttatggctttgcatcctcatagctcagctcccacgtatgaaagagaacatgatatttggttttccatgctgagttatttcacttagaataatagtcttacttccatccaggttgctgggaatgccatgaattcattccttattatggctgaggtggtattcctcatatatatatatatgtatgtatatcacggtttctttatccactcattgattgacgggcatttgggctggttccatatttttgtaattgtaatttgtttgagttcctcatagattctggataatagccctttgtcagatgtatagactgtgaagatttcctcccactctgtggttgtctgtatactctgctgattgttccttttcctgtgcagaagctctttagttaagtctcacctatttgtttctgttgcatttgcttttgtgttcttggtcatgaagtctttgcctaagccagcgtctagatgggtttttccaatgttatcttctagaacttttatggtttcaggtcatagatttatgtccttgatccatcttgagttgatttttgtgtaagctgagagttgaggatccagtttcattctcccacatgtggcttgccaattatcccagcaccatttgttgaatagggtttactttcttcactttatgttttaggtggctttgttgaaaatcagttggctataggtatttgagtttatttctgggttctctattctgttccattggtgtatgtgcctatttttatatcagtaccatgctattttggcgactatggccttatagtatagtttgaaatcaggtaatgtcatgcctccagatttgttgtttttgcttagttttgttttggctatgccggttcttgtttggtccatataaatttcaggattgttttttctagttctgtgaagaaggatggtggtattttgatgggagttgcattgaatttgtagattgcttttggcagtatggtcattttcacaatattcattctacccattcatgagcatggggtgtctttccatttgtttgtgtccatgacttcattcagcaacgttttgtagttcccaacggcatatcaaaaaataatcgggccaggcacagtggctcacacctgtaatcccagcactttgggacgctgaggcggacggatcatgaggtcaggagttcgagaccagcctggccaacatggtgaaatcccatctctactaaaaatacaaaagttagccgggtgtggtggcgctcacctgtaatcccatctactcaggtggctgaggcaggagaatcgcttgaacctcggaggcagaggttgcagtgagccaagatcaccgcactgcatattccagcctgggcaacagagcgagactccatctcaaaaaaaaaaaaaaagataatccaccatgatcaaatgggtttcataccagggatgcagggatggattaacatacacaagtcaataaatgtgatacaccacataaacagaattaaaaacaaaaaatcacatgatcatctaaacagatgcagaaaaagcatttgacaaaatgcagcatccttttatgattaaaaccctcagcaaaatcagcatacaagggtcacagctcaatataataaaagccatctatgacaaacccacaaccaacatgatactgaaagggggaaaagttgaaagcattccccccgagaactggaacaagacaaggatgcccactctcaccacttgtattcaacatactactggaaggcctagccagagcaatcacacaagagaaaacaataaaaggcatgcagatcagtaaagaggaagtcaaactgttgctgtttgatgatgatatgatcatatacctaggaaaccctaaagactcctccaaaaagctcctagaactgataaatgaattcagcaaagtttcaggagacaaaattaatgtacacaaatcagtagcgctgttataccccagaagagaccaagcttagaatcaaaccaagaactcaaccccttttctgatagctgcaaaactaaactaaactaaaataaaatacttgggaatagacctaaccaaggaggtgaaagatgtctacaaggaaaacaactttagtatttttaatgggttaaaatgagaggcagcaggtacagcagaagaagtcagtgcgtgggcatccgcatccaatgggtactgcacctttgatggtaaggctttggttttgacttactaaattactaggtacgattattttctagtttttgtcattaaaccttaaaactactaagtaaccccttccatttcttgttaaatattgtaaaatttcatactctcatttatgctgcctgatgttagagtatttgtttctattttgtgactaccttaaataatacctataaagagtaaactgttagtagtgtttttgctgtaattaaatgtagtaagacttaccttccaaatgataactgaattgtcaaacacttgtcgaagttttggatttactcaaaattctatgctcagcagctggaggtaggaagagtaagggccctcccttactcttatggagaggcatactttctcacaaggggaatactctgcaggaattagcatcttgtaagcagtggtgaattcaactaattagtgtataaaaatacattttttggtgtggctgccgacaaagagatccaagagggtagatggagtcgagcttgctgaagcaaggaaagagaaaagcagtattctaggcagagagcaggggtagagcaggaaaatggctaggtgcaggtcagatgatttatagaatgcaattgatcaagttttgaagtgaatgcaaagtattctccgagagtctcatttgagtcatgtcttggcagtcttatttaaacatgaagtgaaagttagattttttaagttgtcatttgttttcagggtgtgagagaatatgtaagtgatactctttttatcctccacataagaaaataggactagagaaacctatggcttcctcacttgttggtggcctagcagccctggcacacagagcctctgaatctgaaacacttcttttgtaacaatatcacctgaaataatacatttaggattagtaatttagtaaatgcattagtcttgtattcactgcaataaaatgctcttgtagcaggattatttaatacattacattttattgtagtaaataaataatagaagggctgggcgccatggctcacgcctgtaatcccagtactttgggaggctgaggcaggcagatcgcgaggtgaggagatcgaggccatcctggctaacacggtgaaaccccgtctctactaaaaatacaaaaagttagccgggcacggtggtgggcgcctgtagtcccagctactcaggaggctgagtcaggagaatggcgtgaacccgggaggcggagcttgcagtgagccgagatcgcgccactgcactccagcttgggcgacagagcgagactccgtctcaaaaataaataaataaattaattaattaatagaaattctcagctgctttttattgctgcagaaaaaaaatgaaatcttattttaaacttttctttttttttttttttttttttttttttttgagacggagtctcactttgtctgccggcctggagtgcagtggcgcgaactcggctcactgcaagctccgcctcctgggttcaccccattctcctgtttcagcctctcaagtagctgggactacaggggcctgctaccacgcccggctaattttttgtatttttagtaaagacggggtttcaccatgttagccaggatggtctcgatctcttgacctcgtgatccgcccgcctccacctcccaaagtgctaggattacaggtgtgagccaccgcgccccgcgaagccgacttttcccattatttttaacggtaattcataaaatccttgttaggtttgatgacaggtaccatattaagggcagcattttataacccatatcttaaacatcatctctggaagttgagagcctccaatgggttttctatagagtgcacatgataccacactcaggcagttcatggagtgtaagacatatcttagtgctttgtcatttgacattttaactgagaaaataatacactttgataagtttgacttacacttcccttccccttcaggtatctactgtgcgtttcagtcaacaatacagcttgtgttcgacaatattccttgatgacagcacagccatcagcattatcttacaatgacaataatatcgtgagtacaactatgctgccgagggacagattcctttattctaaaattatttcagtcatttggttgtccttttcagcaatcagtttaagaaattggagtcaaccatatattgatatccagattctgaatattaagtatcagtttctcttttaatcttagacgtcgtggtggaaggaaaaatcagttagcaaagaagcaatcccagaaacagtgtatctttttgatgcctttatgcctttagacaatgttgaacagagtgagaaggataggttccctttattgaatgttttcttgtggaaacttagtttttcaatgcatcataggcctaaatcagtgtgcactactttggacattatccttggaagaaggaacagcttttcttcttctggcaacgcagtgtatctgcatttgaatttctcccattgtgcatgagcacctcatgggccacaaagatgcgctttgagagcaccctgagatgaagtttattttaaaaggaacaacaaccaacaccaccaccagctccacaggggctgtccagtgtacattattctcatcttcttgggttattagtcttgatttttagaacacagtttggaaagtgctaatttagaatattaatgtctttatctttaatttaacttttcattctgtacacataactagcttataaacaattttgtttcaaatgcactagcctttttaactaattcaattgtcaataacttttacttcaattaaaagtggaaagtttacactcataataatgtcactttcctccctcccttttaacaatagttgagaggaaattgtgtttcgaacaaaaactggactcaaactctgtctcaagtcctgagctttgggacctattgagtaatcactaaatgtctgtagtcagctaagtctcttaaatctctgagcacacatacacaaaaattactttgactagagtccctggcttcttctgagttccaaagattttcatatgttagcatataattcaaaagcagctttgaagattaattttgctgaaacaaatttcgtgcttttttcctcattattctactttttagaagtctacttttgagagtatagtaagttttaatttgccaccagcaaatttgagaaatgatcatttggtgtattcactattggtgaaataaagttattgaacaaattaattgggcaaattggcttcaagaagatattttgaaaaatgttttatcatgaatcagtagtgcactgttgtcagtgggataggtggaactcgctgagatcacttatgcaaggtttttttcaaaacacaagtctgcaaacacatgtatcttcccatctccactttccctctatctctaggcactgagaagccttttaggaaaatcgggatggatgtgaggcatctttctgtgaagaaaagcatcccagaagattctgattttcaccccaactcaatcattccaaactttgctgctgattgaaatcacctgggaaacgtttaccaagaaccttgatgcccaaagccatacccaatactaattaaattaaaatgtctcatgtggaagatgaggcagatattaaagcttctcaggcgattttaatgtgcagcaaagtttgacagccactgcttaatttgagtttaggatgagaaactgctcctatttggtgggaccttgggcaagtcagttttaaggtctgtttccctgatctgtaaaacgagtgttgaattaaatgtcacataaggtcattggtcctttccagcatgtaactttaaattctgtgattttaaaattatttcagagatgaaaactacttgaagcactatagacatatccatcttacctgctaatgttacaggctttttaaaaagtgctaatattgtgtagacctattagtagaattgagatttgccttccctcagttgttttgaggctcactctacaaaattagctgggtgtggtggcacatgcctgtaatcccagccacttgggaggctgaggcaggagaatctcttgaacccgggaggcagaggttgtggtgagccgagatcacaccattgcactccagcctgggcaacaagagcgaaactccacccaccgcccccctccaaaaaaaaattatctgggcatagtgacacaaacttgtagtcccagcttcttgggaggctgaggcatgagaatcgcttgaacctgggtggtggaggttgtgaggagtcaagatggcaccactgcagtccagtctgagcaagagagacagactctgggtcaaaaaataaataaatacataaaataaatcgcatgggacgaaaggtttcgtgggtagaaaagcatgtaacaaggaaatctgttattatttatatattgtaatcaccaacagaaacgcgtcttctaacggcatatttccttgcattttggttctcatatttttgtaaaaaacaaagaaatgaaaacaaagtgcccttatggtactgttctgaactagaagatttgaatttcagggccactaggagagtttcctctgccccccttttaaaaaatgtcttcaggcctaacaaatgttaacatctattgttatgaattttttttccttccacagtgtgaccttggagatacctcatcatatcacacaaaggtgagctttttagaaacctgtcttgttattctagctaagtactttgcaagatatcaagctcagtgttaggcacatcataagctgtattgtgcctactaaaatattgaagcaaattatttgtattttctttgttccttaagactctcataattcttaaatgattgagaatctcaaagagtatgtgtttatattgattatattgatatttagtgtggtagaattatacaattgaaattttttcaaaatctatttttagtttagatttcacagccttaccactgttgatattatgggctagataatgctttgttgtgaggactgtcttgtgcattgcagagagtttagcagtattcatggcctctaccaactagatatcagtagtaacccatgacccaggttataacaacagaaaatattccttgagaacagtattgttaacagaattttttcattgaaaaataacttttctacaacaaaaagttgagtaaaaagtgcgtcatgtatttatattatttaaagtctctcatgttgagcttaataggagacaaatggattctctagagctttctttgcaatttgctttaaagcagcaataagaggttgggcacggtgtctcacgcctgtaatcccagcactttgggaggctgaggcgggcggatcacaaggtcaggagatcgagaccatcctggctaacacagcgaaaccccgtctctactaaaaatacaaaaacttggctgggcatgatggcacacacctgtagtcccacctattctggaggctgaggcaggagaaccgcttgaacttgggaggcggaggttgcagagagctgagatggtgctattgcactgcagcctgggtgacagagcaagactctgcctaaacaaacaaacaaaaaaagcaataagctggtggggcgcagtggttcacacctgtaatcccagcattttgggaggccgaggtgggtggatcacttgaggtcaggagtttgagaccagcccgaccaacatggtaaaacccgcctctactgaaagtacaaaaaatggctgggcgtggtggtgcatgcctgtagtcccagttacttgggaggctgaggcaggagaatcgcttgagcctgggaggtggaggttgcagtgagccgagatctcgccattgcaccccagcctgggtgacagagagagactctgtctcaaaaaaagaaaaaaagaagcaataagatgaccgaacctcatgcaaatatgtagttggtagaaggtgtatttttaaacttttcagacagttgtgggtatttgttaacactaaatcaaaacttcacaagtggtggtttcttaaattagttacggtggcattttacatattaataaatttattccatcagtactcattgatctttcttccacagtaaatggatcttttgctccatacttgcatttataatatcatgcattagttacttggaatatatcggtttatgttttattgtgtcaaaaatcacttttagtttaaccaccaatcttactttaacacgcctttaagtattgaatagctgccaagcctacagtagaaggaacaagtttttcaaagtccacaggaaagcttaaattttatcattgggaacaaatacgtatttcccttgaagtgacaacctctcacttcatttatttttgagaatgatagttgaactggttttttagaccgagtttcactctgtcacttggctggagtgcattggcatgatctcagctcaagcaatcctctcacctcaggctcctttgtagctggcaccacagatgtgtggcaccacgccaggctaattttcttatatgtttgacagtgacagggtttcgttatgttgcctaggctggtctcgaactcctgaaggagctcaagccatctgcctgctttggtctctcaaagtgctgggattttacaggcgtgagccactgcgctggcccagttgtacttttaaataaaaatgatgttctgtgaaaaaagtgatttttcagttcatagttaaatcacggattctttaaaaacaaaaaaaaaagcgcttctggttaactttccacttattcagaatattagagacatgtcaagatttaacaacattaatttttactgcttcatcaaagacattcttaagaaattcaggctatgttttttacctgtaggggacagtgaagaatagaatgactactaatgtaattggtaccactgccttgatttatgctgagaaaccagccattgtacccacttttgcttttatataatcatggcaagtgtcaacgaaagagcaggcaatggctttgtattactttcacaaatttttaaaatttttcatcagctttctcaggtttaattagtatgattcagaacagtgttggccaggcacagtggctcaggcctgtaatcccagcactttgggaggccgaggcaagcggatcacctgaggttaggagttcaagaccagcctggccaacatggtgaaaccacatctctactaaaaatacaaaacttagccaggagtggtggcaggtgcctgtaatccctgctacttgggaggctggggtaggagaatcacttgaacctgggaggcgaaggttgccatgagccgagatcacaccattgcactccagcctgggcaacaagagtaaaacttggtctcaaaaaaaaaaaaaaaaaagaacagttatgacctcttaggccttctggaaggggtcttcgggatcccgagaggtccacacagcacatttggagaaccactggtttatacacaggcacaatgcattagttttacaaagtttaaagttcatcaaagactggcgtcttaaaaaggcagatgagtttgtcattcaaacaacagaaagtacataaatacatcatgagagtatactacagagaactaaagagaaaggaagctaggaaatctgaatcacatttacatttattaaagtttactactactgctttgtagaacattcttgtgtttcaatgtgtggttagaagagtgaaaatatgtttggtttattgccatggcctgttagggagagtcaatactcacgggcatttctgactggttatcatataaaagacttcacggtacaggccatgatgtgctgagaaagaagaagtcaggaaaccctctgcaagtcaggatccaggagaagaattcgtaaaaactgctttggtaaacaccaaagcacacaggaggcagtattttactaaacaaatattatactaagatattaacagtttttgaagtaacgcgctttcttattttatagagatgcagatagatctttgagcatacctgatgaacagttacactcatttgcggtaagtggcacttttattgaggttgtattttcatcgtacacttgtatctgtttcatgctgaagtcaaagccatctttttttaaatcttccccatttcatgttgcatttagtcatcttaagtgttgtaaaaagaatgtgctggagtaagaactgatctgcagctctgtttagttagtgagctagtatgagtaaatatactatccaaacaacagaaaatgtatctttttttttttttttttttttttttatggactctctttctgtagcccaggctggagtgcaatcgcgcgatcttggctcactgcaggctctgcctcccaggtccctgttcaagcaattctcctgcctcagcctcttgagtaactggaattacaggcatgtgccaccatgcccagctaatttttttttctttttttttttttgtaaagacagggtttcaccatgttggccaggatggtcttgaactcctgacctcgtgatccacccacgttggcctcccaaagtgctgtgattacaggtgtgagccaccatgcctggcccagaaaatgtatctttttaaaaggtaattgtgagctgtctataggaccctgcaagccactacccaatttttgaagccattcctccttctgttccacacaggtttccaccgtgcacattacgaagaacagaaatggaggtgggagtttaaataactattcctcctccattccatcgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggcgtgctcacctattattcaagcttaggtgattatatgaagaatattcataaaaaagagattgaccttcagacatctaccatcaaagtcccaggaaagtggccatccctagccacatcggcctgcgcacccatctccagctctaaaagcaatgacctatccaaggacatggacaccgggctgggtgactccatatgcttcagccccagtatctccagcaccaccggccccaagctcaacccgcccccctctcctcatgccaataaaaagaaacacctaaagaagaaaagcaccaacaactttatgattgtgtctgccactggccaaacgtggcactttgaagccacgacatatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcacccgcctttcccgtgtgcgatctctggagctggatgactggccagttgagctcaggaaggttatgtcatctattggcaatgacctagccaacagcatctgggaagggagcagccagggacagacaaaaccctcagaaaagtccacgagggaagaaaaggaacggtggatcctttccaaatatgaggagaagctctttctggccccactaccctgcactgatctgtccctgggccagcagctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacgagtgcgtgtagttctgttttatttgactacagtctccttggtgcaaaaacaaaatgggaaaaataaggataactcagaatttcaaaaggaaatcacaaattcagcttataatagcattttcagtacttctcataaactaagtaaatacacaaaatgttgatttttctgaccataagacatattttatgtccttttgccgaggtggatgtgttagtctcaggccctcctggccacattgcccaagtcacacaggcttctgtattatgtatttagataagatgtgtgaaaatatatttgaaaaaaagttcataaatttgcattgatttttgtacacatggcacctctttttcattttttttttttttttggacgatgttttgctctgtggccccagctggagttcagtggcgtgatatctgctcactgcaagctctgcctcccggattcacaccattctcctgcctcagcctctcaggtagctgggactacaggtgcctgccaccacacctggctaattttttgtatttttagtagagacatggtttcaccatgttagccaggatggtctcgaactcctgaccttgtgatccacctgcctcggcctcccaaagtgttgggattacaggcgtgagccaccgtgcccggtccgtggcacctctcttaatttataaattgaactgaatgtgaagtaataatgtcagctagttgagataagagggttacagatcggctgggcgcagtggcccacacctgtaatcctagcactttgggaggcctaggcggactgatcaccaggtcaggagattgagaccatcctggctaacatcatgaaaccccatctctactaaaaaatacaaaaaattagctgggcatggccgggcgtggtggctcacacctgtaatcccaccactttgggaggccgaggcaggcggatcacaaggtcaggagatcaagaccatcctggctaacatggtgaaaccccgtctctgctaaaaatacaaaaaaaaaaaaattagccaggtgtggtggcgggcacctgtagtcccagctacttgggaggctgaggcaggagaatggcgtgaacccaggaggcggagcttgcaatgagctgagattgcaccactgcactccagcctgggtgaccaagcgagactccatctcaaaaaaaaaaaaattagctgggcatggtggcgggcacctgtagtcccagctacttgggaggctgaggcaggagaatggcatgaactcaggaggcaaagcttgcagtgagcagagattgtgccactgcactccagcctgggcaacagagcgagactcggtctcaaaaaaaagaaaagaaaaagagggttacagatcattgcacatggaaaatattcccagcagtaaacacttccattaatgtgatctacagcttttaaaaaggagcatctcagaataagatggtggtacaatttgcttattgagaaaggaaaaaaaaatacatgagtatattacaaagggaaaagaaggaatgtgatttctcatgattgaaagcttgatttagattgcatacagcttttgctacccaagaccaagcagctctggcaagacagggtggttttccgaatgccagaccgaggtgccttatgaaggcagctgccgatggttccagatgtagagagataggtgatgcaggagggaaagctggattggaaaagggagagttttgtagacgggctatgctcattgtgcctttgaaagagcagagctggcagcctgtagtcatcatttggatatacaggactagagcatgaatctgatgtagagctacagaatgaagagcaacagcagctgtttaaataccgagaaagtgtgtagaatgaaattggacgagccaagcatggtggtttcatgcctttagtcctagctactttggaggctgaggtggggaattacttgagctcagcagtttgagtccagcctgggccagatggtgagaccctgtatcttaagaaaagaagaaataagaccaggtacagtaagtatctcatgcctgtaatcccagcactttgggaggccaagttgagaggactgctcgagtgtaggacttcaagaccagactgggcaataaagtgagacccatttctaccaaaaaaaaatcaagaaattagctggacatggtggcacatgcctgtggccccagttacatggcatggcaggctgaggcaggaagatcacttgagcccaggaggtggaggctgcagtgacccatattcatgccactgcactccagcctaggcaacagagtgagaccctctctcaaaaacagataaagtggacagaaaataggtcggtaaggactaatcatttaagggacaagcccccagaagagtggctactagagtgggaggaggaaaagcagaaggagaaagagttgaagataggcgaggctgtggtcccagtgctgaattctgccaagcagtgacttgattcatgaacactcactggatgctgactctgttgctcttctgagtgctggggtagaggagaggagaggtggagcacagttcttgcttttatgagcttatgttctaggaagttcaaacaagtattttttcaggtagtatgaaatagcaggaagaggaagcaggctaaagggacacagagtgattgggggctattttaagtagaatgataaggaagagcctgtctagagagctatttgaacagtgacctgactgaagggacaacagaaagcagtgctgacattacaggtagcaggatgactgccaagacagaaacgcatttcatatgtgttcgaggaacaaacagcaaggtgaccagcatggggagagtgaagaatgagggaaaccttgaatgagaataaagcaattccatcttggatgctaatctgcaatattctgattaatcccagttccaacaattcatctacgatttctattttatctttttaaaaaaattattttttattttttattttttgagaccgagtctcactctgtctcccaggttggacttcagtggcacaatctcagctcactgcaaacttcacctcctgggttcaagcgattctcctgcctcagcttcccgagtaactgggattacaggcgcctgccaccacgcctggctaatttttgtatttttagtagagacgaggttttaccgtgttggccaggctggtctggaactcctgacctcaggtgatccgcccaccttggcctcccaaagagctgggattgcaggcgtgagccaccgtgtctggccatacacatccctgctgaagcccgcattacccttcccctatgctatagaagccctgggtcgggggggtgggggtgatggcacagggatccaccatcttatcttggtgccatccctgacttgccttctgttcataaacgcctattaaatgtttctttctgagaaactggatttgtcagcctctttctttggtatctcaggttccttggcctttgcgggtaggtttatatagacctgctcagcacaggacaggcagtttctcaaaaaattgaaaatagaattaccaaatgatccggcaatatcacttctgggtatatagccaaaataattgaaagcaaggtctcatagaaatatgtgtacactgatatttatagcagtggtattcacactcgtcaaaagatggatgcagccgaattgtccataggcagatgaattgataaaatgtggtatatacatacagtaaaatattcttcagccttaaaaaggaaggaaattctaacacatgctacaacatggatgaacattgaggacattatgctaagtgaaataagccagttagaaaaagacaaatactgtgttctttcacttatgtgaagcgtccagactgagtaagcaaactaatagaaacagaaggtagaacgggggttgccagggacatggggaagggagaaaatgggaagttgcttagtggatatagagttttggttttgtcagatgagaaagttccggagattggttgcatggcaatgtgaatatactctacattacccaacccaagggctctccttgacccctgttccaactgccacttagaagtggttaaggtagtaaattttatgtatattttaccacaattcaaaatagaattattattattttttttattataattttttgagatccctcactctgttgcccaggctggagtgcaatggcaccatctcggctcactgcaacctctgccttctgggttcaagcgattctcctgcctcagcctcccaagtagctggaacttacaggcacatgccaccatgccaaactaatttttgtatgtttagtagagacagggtttcaccatgtttgccaggctggtctcgaactcctgacctcaggtgatccacctgccttggcctcccaaagtgctgggattacaggtgtaagccaccatgcccagctgtcaaaatagtttttttttgtttttttttttgtttttttttttttttttgagatggagttttgcttttgttggccaggctggagtgcaatggcaggatctcggctcatggcaacctccacctcccgtgttcaagcaattctactgcctcagcctcccgagtagctgggattacaggcatgcaccaccatgcccagctaattttgtattttattttagtatagatggggtttctccatgttggtcaggctggtctccaactcctgacctcaggtgatccacccacctcggcctcccaaagtgctgggattacaggtgtgagccattgtgcctggccttttttttttttttttttttttgtgatggaccttcgctcttgttatccaggctggagtgcaatggcacgatctcagctcactgcagcctctcctcctgggttcaagcgattctctttcatcagcctcctgagtagctgggattacaggcatgcaccaccacgcctggctaattttgtatttttagtaggtatggggtttctccatgttgatcaggctggttttgaactcctgacctcaggtgatccacccgcctcggcttcccaaagtgttaggattacaggcgtgagccactgcgcctggcctgaaaaaaaatttaaaagtttgagaaaatataaaatttttatagtctccatgtatttctcctaagatctttccccctatgaggggaggaaagaggaattattataacacaggaagatgtttaatactcaggattttttatatcatcatatttaaagtctttttctgcacagctaaatctgattccctgctactaaatctgattgagttagcaactaaactaactgatttggtagtatctatccagatcacaaacagaaatattgttaagactccctcaaaaaggagtttaacctcaataggtaactcctcctaactatagttctaaattaatgaaacacagtagtcatttaacaagatactagtatatatggccattggggtatatgggacatgctacctcaaaatatgacaccttggcatttgagaaaacagaagcagaaaggtctctctgacctttccctggcccttctcctctgaagcaggacatagaagaatcctctaaccctctctggagtaggtcataagaacttaattccagtcctccctattcccagaggaaaggagcctccttatttgtaaagatgcagagaatgatctgaccacacaggccttgctgagctcccccagcttattcccttcaggtcacacccctttcatctaatcgtgcttctccaaaactgtccgcttcttcatcagacagcatccaattgacacaggatttcctgtttctcttgagtttttctttctgaaggctcctgtgtctggtaaaacttatcttacgtaaacttgcacacttttctctggttaatctgtcatttgttctaagggactcgaccatgaacctagcgatggctgagaaatcatttcccccctagccggcctaactcatttgaaggagcatacactattgtgtgggagtcatacttattcctaaccattttgaagagattcatctttaaattaatatattacattaaatgtcttccttcagaaaagacaatcttgtgaacatcgcctttggtgactgaacatcacgagatataaaacaggtagaaaaagaaaatatttggggtggctctaactcttaaatcccatgaaataatcccctcttctttagcagaaacctcagctcacctcctcatcactgctgaacaacagggcagatgctttctttttggagagcttggaggcttttgctttctcttgtctttgagcttgtagagacaatgtctgcttcttagcagctgtacccccaaaaagattatcctagaaaagcaaatggcagaaaggtaagacaactttataatcagaaaacataggatgtcctcctatatcaaactttaaggaagtaagtctccagtcaggtatacaaataacaactctggtgaggaaaaaccacaaaatgctagtaaatcccaaactacagccttttctcactgcacccatagaagggaaagagattaccatagaactcgaaggcagaacagctgtgaataagcaggagaacaacatgcgaatgagatcatgaagtacaaggagaaactgagccccatccagtcgccctgtgggcaagtgcctctctgctcatttcaggtggttacagcctgcgatgggcacgggagcccccgcagcagccagaaactcacactgttgtctccacaaatgagaaaccagaacaatggctgaaaggagagaactgggggtctgtctccactcctttacaggtcagaaagacatacacctgggatggagggaaggcatgacttgtgtttctcattagtttcaaagagattatacaaagtggagaaatagcttactaaataaaattgctggtgtactaagtttaatggcatttgtaaattcttctgtggtcaagcactccccaaaagttatatttattaaggtgcttttattcagataaggggaacaaaagcatcagagggcctgagtctgagttaggatggacaaactcttaacagcaggtgaacagccctggaatgtgaagatggatgaagggagtgtcttcctggatgaagtctcctttaaggagagtgcggtaatgtaggacaggccaggagaataatgagctggtgtccattggggatgctaatgacagagctcacattcactatgcacttattatgtgccggcactctgcatgagcttcacactagtagttacagctgccacaatgaccctactcactgttaagccacatgagcttaaggaaggttaagttacttgccccaggttcctggtttgcaagtggtggagctgggatatgaacccaggggtctgatggcaaagcctctgagctcaccaccgcccagtactgcatgagagttaaggtttgggttgtcttctctcttatttctcttccccactgtgctctctccagccaggatgggaaagaaagacaatggtcaggacatggctgccttctcctttgtatctccacttgatccaaaacattcttgtaggtcattgggtatatgttgatccatcctctagactaaagtacagctcaccctgaatgacacaggtttgagctgcacaggtccacttctacacaaatgttttctcagtaatatgctgaaaattttttttggcatttgcaacaatttgaaaaatcttgcagacaaaccacttagcctagaaatatcaaaaaaaaataaggaaatgctagatatgtcaggaatacaaaaatatataaatagatactatactatttataggttaatcaactgtttgtgttacccatgaggcttctggttaacagtaaggtatcagtagataagtttttgggaagtaagaagttatatatggatttttcactgcaatgtggaagccaaaacaacctcctcactgttaaagggtcaattgtatttctcaaaggaagatttctaaaaataaaacctgtagatttcactccataagaactgtgtcaagaggccaggcacggtggctcgtacctgtaatcctagcacctagggaggccgaggcaggcagatcaactgagatcaggaatttgagactagcctggccaacatgatgaaaccctgtctctactaacaatacaaaaattagccgggagtggtggtgcacgcctgtagtctcacctacttgggaggttgaggtagaagaatctcttgaacccggttgcagtgagccaagattgcaccactgcactccagactgggtgacagagaaagactccatctcaaaaaaaaaaaaaaaaaaaaaaaagaactgcgtcaagaatctaatgtcttctccattgcacagctaggaaaatataaggaagaagtcactgaaataaaaacagaaatatttttgttatataaacttcaggtagcctgactgcttccctaccaccttttgctagtatatgagcctctgggtagaaagttacatcaacaaccgttttctcctaatctaaattatctagtgttacaataacaatgtttacctcttcatcttcatcatcaaacagggaaaccgacgtggggagcttgccaggcagcagagacgcaccttttaagttactcgcactttgagaagaaaacaaatcctgttggattgaaattaaaaagttgctggttaacaggaatatcagtttttaaaatatcaggtcagtataaaacacaagtgactcagacatgacagctgccatgtgtctaggcttctttcctgagagggaaggtggctcagacagagtccttaaaggaggcctcagggtctgtgcagggtgtgtgcagtggcgctaaggaggaggagagctacaggatctggtgggctcgcagagcccaggggcttctgtattcccacctgaatgacagaaggcaggaataagtttttgaatcaatttcctacaccatgctaaaaaaataaataaataagaatggcttcccattactgtctaaagaatcagaaattagacagggtcaataaagaaataggagctagattcccaaattaagggacctacaactattttatttcgtaacacccttctttcctaagattatgacttatttctttttcttttttctttctttttttttttgagatggagtctcactttgtcacccaggctggagtgcagtggcgccatgttggctcactgcaagctctgcctcccggattcacaccattctcctgcctcagcctcctgagtagctgggactacaggcgcccgccaccacgcccggctaatttttttatatttttagtagagaccgggtttccccgtgttagccaggatggtctcgatctcctgacctcgtgatccgcccgcctctgcctcccaaagtgctgggattacagacctgagccaccgcgcccagcccacttatttcttttaaataaatacaaattaaatttttatttgtaaatgtttgatagtctacttagttttactacaagtatatgatgttgcaaaccaggataagacctgctagattctgaataaactttcagcctggcactgtggctcatacctataatcccagcattttgggaggctggggcaggtggatcacctgaggtcaggagttcgagaccagcctgggcaacatgacaaaaccctgtctctactaaaaatacaaaattagccaggcgtggaggtgggtgcctgtaatctcagctactcaggaggctgaggcaggagaattgcttgaacccggaaggcggaggttgcagtgagccgagatcccaccattgcactgcagcctgggcaaaaagagtgaaattttgtctcaaaaaagtaaaaaatataaaaataaagaaattttcaaaacgttataagacatcagcttatcctgcaaagaaagacctacaaattgagctacatgaagtagaaacataaaatgggacatctaatcccttgggaagagaaacattaatacacaagagctgaacaattaaataggacaagaacatattttctaagacctcttctgacagtttttttttttttaatcatggggttgatgtctactcctcaaacatagacctaatgagttcactaagtgagatctcctccacacagtgtttttcccctgtgctccccggagtcccatgggtttatttagatagaagaggccacaaggggaattccaggcatcccgtgtccctcctgcatgttacacaatggcaagagaaagggttctgctgttctaagaaaatgaaagtaaaccaaagcaaagaacaaaaacaaatgtcaacatcacagttttggacccttaactaatacttttattggtactgcaaaaaaagacacttccattacctcaaatatgttcccctaaaatgacttcacagggcaagcttcagccccacacttgagatacagagaaaggagtcaggacgcattcctttgggtccaaagctttaactcttacttagactgccttagttttacttctccttgcctcagaatctgaacaatatccaataaaaacattcactctatgatgacacacatgaggcaaagcctttggtagggttttcacacaagtctgagagtacatttacactcccaccatcaagaaggggagcctatggcccctccccatgaacctggatgggccattgtgaccatcttgaccaacaaatgaagcaaaaggaccaccgttgacttccaaggctggaacacagaaggcaacatggcctccactgggctctctctgaggactctcccctacagccctgagccagcatgtaagaggaccggcttccctgactacatgctgggagccacacagggctagtgagagatgtcccaggggccccagtgcccaggtaccagacatatgagtgagctgaccctcagcccagccaccttcagacacaagagaccctcagtgacaacggcctagctaagcccagtcaaactctcgaagtatgagataacaaaactactggtgttataaactactaggttttggagttacttgtttcatagcaacaaataaccagaacatctcgtaagtcactgaaattgctcacatttggttttcttgtctaatcaacaattactggatggcttaccacatgccaagcactggtattaaggacagggtgctggggatacaaacagggaataaaaagtcctgtccttgtggcacttactttagtgggaagtagagacaatgaataagtaaatatacattgtccctggcaacacgtgctgtggtaaacagtgaaataggaaagaggaccaggagcacagcgtggtatgtgctagcaggcttcctgttgtgtgtatttcatcagcgaggcctcacagagaaatcgaagagtgaggaagaaagctggattctgggaacagcattcctcagagtggcaggggccggtgcaaagaccccgaggtgcaggtgtgggtgacacaggggatccatgagcataagacggtggaggccccatcatgctgtttctcaggggtcagggttgtgacttgactggactttggttaattgccatgttttgtacactcgccttcaatgaaataatagcctcaaaggtattctttacgtcaagggcaatcactatacttccaaagggttccatgttcatccttgctgtgagtgcaaagcccaaccatgacagcctaacctagagcccacagtttcttgaaatacatgtaagtttctgccatgtccacatgtttttctgtaaaaggggcttattatttcccattacatttctcatacaggtctccgatctcctaaaaggccaacttaaaattagatctaagacgacctaggcctgagagattcaggaaaagcagtgaaattctgagaggtggttctaaggtacctggagggaccaaagcaacctgtgaaccagggtcccacaggctgttagtggtctcagtctcgacaagacagatggctatgccagaacccatctgctacagcattaagccacggtctagttagtgagaatgtgaataaaggaagtagcatggtgacctccactctggtgcaagctcctcatcacatcatgagcccatgaacagtttacaatctgagcatcctaaaaagagagtattttcatcccaggaaacgtaaatacagtccaacccaaaagtgaaaagtattgtaaacatattgctttctaaaacccctgtgctctcaagagattattttttattcatttatttattttgagacgaagtctcactctgtcgcccaggctggagtgcaatggcgtgatctcggttcattgcaacttctgcctcccgggttcaagtgaatctcctatctcagcctcctgagtaattgggattacaggctcgcaccaccatgcccagctaatttttgtctttttaatagagacagggtttcatcatgttggccagcctggtcttgaactcctgacctcaggtgtccacctgccttggactcccaaagtgctgggattacaggcatgaaccaccgctcctgacctctagagataatttttaaagaactggagtacttaacgaaaagtcttataactctgctgagaaaaacctgattcagaaatagtttctatgtcatatccatagactaatacccacaactaaggaaaagaataccatacctcagagtcctcctgatcctaaaataagcctttttgagtgtttgtttctgacgagggcttgagatttttgctggaaggtaaggtaacctttgttgggggaaaagaaaagaaaaagaaaaattaagcattaacaaataagatacccagaaaagagtgtttactcaatcaaccatttagaaaatgcacggagtctctgctgtgataggcagcaagccgagggggctgttaggagaacagcaagacaaacagaggacacatctggtgtatcagggagcaggacacacagtctgggtcaatgggtgcacagatgggacatatgcaatgagagacagcatggaaagacaggctgcctgacaggcctaccaggttctgaatgctgggccttagggggtcggcaggagaaagtcagggtttcacagccaggacatgacatgatgagacaaactgtagaaagaggagggaccagctgtacaggacagcagtgaaaggtcaagcagtcaaaagggcttaaaaactgctggggacacacacactggccaaatgcaggtcaatctgagcaccaaaaactatgatggtctggccaacatggtcaaacccagtctctacaaaaaaatacaaaaattagctaggcatggtggtgtgcacatatagtcccagctacttggtaggctgaggctggagaatcgcttgagcccagggggttgaggctgcagtgagctgtgattgcaccactatactccagcctgggcaatagagcaagaccctgtctcagaaaaaaaaggaagaagaggaatgatggtaatggattatcatctacactgaagaatgaattcatgatcccaaagcaacactaaaaattagggaagcagaggacgaggaaactctttattcagaagataccaactaataagaaatatagaattaaaaaagcagtggtttatgaccactaacaggttaactgattcaggaaaagatcatcagtggattttcaaaacactgagtaaaaggctgggagagaacaggtattcacactgttcagctatcactttagagatcaacttagcaatggcaaaagagaacagggtacctttccaatgaagcagtgtggtgggcaccctaacaaccaagtgacaaacgtgtctgaatgaggcagacagtggacctgatgtatcttgggaggtgatccaactggaagtgcacaaccctgcctgcttgtattcttgccaaaactgctcaccctgaatcaattcatagaaaaataatcaagcaaattcatgcgacacattctacaagacaagtggctggacgttaaaaaaaaaaaaaaaaaagatgtgggaggtgttgcactagattaaggagaccaaagagacaggacaaccaaatgcaatgcagacatactgcctgaatcctgggtttcttaaaacaaaacaaaaaaaatcaaaatacacaaaaatactataaagcaggggtccccaaccctgggctgcagaccagtccatgacctgttaggagccaggccgcacagcaggaggtgaggtgagcagcaagcattactgcctgagctcctcctcctgtcagatcagtggcagcatcagattctcataggagggcaaacgctattgtgaactgtacatgcgagggatctaggttgcaagttgcactctcctaatgtccccaatgccaaaaaggttggggaccgctgctataaatggcattttggggacaagagaggaaattacaatataaactatatgtgagataattttaaatctgtattctatttgttggggtgattttacaaagacattctgggacaactggagcaattctaatacagactagatattagattctactatagaattactgttagtctcacagctgttgataatggcattgtgcttatatggaagtcttttcaagagaggcttaatgaaatatttaggggtagaatgtcacaatgactacatggaaacagttccatgcagcaaacagttcaaacaacttacatgcaaatagttcaggaaaaaaatagatatgtaacaaggtttacatccataaagtgtttgccaaaaccctaagaactgatcaatctgggtggcagttatttgggtgttcactgcaatgttctttccactttctgtttgaagttcttcaatatgaacgtgaaagggaacagtacttccctctgggttccggatgaattattaaaatgctgcagatcaatgctcctgcgttaagtcctccctcctgctcgcctttttttctgctcttgctttattttcatctgtctgactcaccgtggcttctggcgatgctacggctttttctttgaacagatctccttcttcatcaccaaagatatcagcagtggattggactttgcctttaaataccaaggcataaaattacaataaggccggaaatcctaccacaaaaaatcctaccacaaaattcatagaataaaaaattcttccctcccgaagattaatatgaaagttacattgtttcttggttacttataaagaaatagtaagtggaactatactcttcccttcaaatttttcaaagagtgtattgacagctcagttgaaagacagaacaaatagtttaaccatgcagctgacatgcttatccaagcagcagtctcctgctgcggttagagaagcttggactaacttaaaaggtgaagagggatctagaggaagaaagatcacttaagaggaacaccaagtcaatcatctaaggaatctgagaaatgaaggctgggctcctgctttaaaaaaatcaaactgggctgggcacagtggctcacacctgtaatcccagcactttgggaggccaaggcgggtggatcacgtgaggtcaggagtttgagaccacactggccaacgtggtgaaaccccatctctactaaaaatgcaaaaattagctgggtgtggggcaggcgcctgtaatcccagctactcgggaggctgaggtaggagaattggttgaacccaggagacggaggttgcagtgagccgagatccgccactgcactccaccctgggtgacagagcaagactccatctcaaaaaaaaaaaaaaaaaaaaaaaaatcaaactgtacaaaagcagataaaagcaaataatgaaattccctcataattccacctgcctactcgaacaacatggacattggaaacagttcagcatacatgcttccaattcccccaaaggatgtactaatgagttaacactagttatttacaaataaggctataaataagaaggtaatttgaacaatgtgtcttaccatttgtattttccacttaatgtacctataaaaccttcccaagtcaacaagcgtagaccccactcgttttaacagtcgcacaatattccactgaatagaagggccatcgcttactctactgatgaatattttcaccacagtaaacactgctgtaccgaatggggcatgcgttgctgaaatgaggtcactgactcatgaatgtctgaagagactaggagttgtcaaagaaagcagcatcaatttactagtgattctaaatcagttctcaaagatatccactaagtgagagccctgtggagctacaaaaagcactactaccttcattcactgtcatcttcaccgagacctgcatgcattctgcatccgtttgcactctttctagattaactaggctatcgttttccctcgtgctttggcttccatccttactttctacacctaacactggaaaaggacagtaagtccagacagtctgcttctaaatgcattctgattccatctattcctatatcatccttttttattttttaaagttgctgaaaatcatgtgcaacttagggatctagggatctacctttcttttctggaagagcagtcaatggatctaagtcttgctattccaagtgtgatctacagaccatgaagcttgctggaaatgtaaattctcaggccccaccctggacctactgaatcggaatcttcattttgacaaaagcctctgggagattcatctgcgcatttaaaaacaaatgatttacaggaatgacttcaggaacacaggacttacatttaagaggaaaaagaaaggagaatgccaaaaagaaaggagtggccaagtggatgaaaaccccatcatgtgaagaaagaccaaggccacctgagctttttggcagagagaagagaagctgggaactaaacggccagcacacaaaatgctgctcatgtaattgactaaggtcagctggaagaaagtatgattaaaactttataattccaaaggtcagaactgcgaattaagcaaaaattatagggataaagacttcagctctctataaggaaaataatcatagtaattagcttacagagcagaaaagattgggtcataaaacagacctcccaggcaccacacctacgtaagtacagacacaacagctcaatgacaggaatgctggggaagggattctggtactataagagatacagaactaggtgagcttatcttccatttaggcaacattctttttctggctgaagtcctagacacagaggcaggaacaaatacctgttttggaaggtttgctgtggggtgtcgagaaaaagtcgttatcatcatcaccatcatcatcatcaaacaggccagtgggagggggaccataggggcttttccttggagtgggctgctcaggcttctgtggctccttcagtgatggaacggaggcagcacatccgtgtctcctgtgagtgaagggacaagacagacacagctgtgagccagtgtgggcctgttgaatttacagaaaaaaattatcacccaccaaaaactttccatttcagttaatccacaaaatgcattaacagggcccaatagcctccatccattactgctacagaacatctcacaatggagaatcaccaggtcactcaaacacaaaaaagtccaaggccactgagctctaggagaataagagctaatatcagtaaatgagctctttctatacgctgctcaaagccctttgaagctcccaggtacttcctcatctccagccaggctttagaagatgataattttgaaatggaaaaaacagtatttgtgtagtttttagaaaacaaacctgttatgttacctaaaaatacagaaacagctcctgctaggattttctttccaggtttggatgatgaagactctagaatgagaaagcaagggataaccatttttacaagggaaataactttccttgctattttcttcctgaaatatgtgcaatgtaacacacagctagtaccagaccttttgaaactactttttcctgaacaagccattttaaaattctttagtattttcttctctactgacatcaggacttttttggggggattgatacaatctcagctgtgactccaatggaagagcatgctgaccgtcatcaagccacagcagtgggtcagctgggggacaccaagggaggaggtgagcacagctggcagaggcagggacagcatgaccggggctcccccaaacagttccacctctacccattccagttggatgagaatgaacgagtgaaaaagaacagcaaaaacatgtgagtcatcagtaaaaaaataaagacataagagcaaagggggaaaccaagcaagtcactgatgccaaaacgtggacagcagaatgcagaggagcccgcacagcacgcacaaggagcggcttccaaggcccagctctgatgcctgtgcccgggagactcggcacttagaatcactaattcccaagtcccaagaactaccacaaacctatggagtaacatttgtaggttaaaaaacatatttatatttgtgttttttaaaaactgcaccaatgggacaggtgcagtggctcatgcctgtattcctagcattttgccaggtctaggcgggtgatcacttgaggataggagtttaagaccagcctgtccaaccgtcgtccaacacggtgaaaccctgtctctactaaaaatacaaaaacaaaaacaaaaacaaaacctgtgcagatgattttaatgcacactgggttggggaattactggtctccaacttatatacagaatgttaaaaacgtttctttaaattaaacttcattcaatgaaaatcatcctcaacattgctctagggtacttttcttgtctgactttttatgagttctctcctaacaaagaggcaagactgtggtatgggtttaccggtggtactgttttttccaagacatgaattagtgaagatgaattactttcaactggaccgcagtaaaaacaacagcttcctgcttaacacagaaacaaggcttgggaacaacctcagggttccatctcctagtgagaaagacagttttggaactctgcacacggagacgcagctgcccagccccagcttaccctccttaacagaggctccagcttgccgatcctggggggcttccgtgaagaggtcactctggttgaaataaggtatatgacaaagaattcaaaaaaccaggagaaagcatagctgcatgtgaggattcctaaggaaaaataacctacaagatttaaagctacatatttactactctgccagaaaatcagttgcaaagtgataactatggcaaaatcagaccctaaaataatttaggcctgtccaggaattaaaaacaaacgtggaagacaacagataaggcaagaaacaatcacctagtaaattattcacattaacacgtgcacatcttctcctcacctaacaaagcacagaaggatacggcatttctcactctgtgattcttagttcaaaatgtcccaaaatatgaaaatagaagcaacttccaactgagaaactgttttttccccactaaacaagcaaagcctatttcttccctgtggacccctgacacagctagctgcagggagtgttgctgagtgccatggactcacctcctcgtcctcatcatcaaagagccccttgcccccactgaacaggccacctccagagccaaatggcgagaagtcctcgtcggtcagcttggggggtgcgaataagttatcctcttcatctagcaaacagaaagcaatgttttgcaaggagtattaaagacgggtccggaactcaaattcctgggttggcgtctgcaatgtctccaaactggcatgaagtttatctgaccctctttatcgaagtgtgaggcagtctgacgaatttcacactaaccccctggcacagtccactgacaccctcaaaagactctctgggcctccactctcaagtctgtccatgtctgcggcagacagcattcattctctaggccagcaccctggatctagatttactctgaagcaagcattcaggtcagatgccacattcaagacccattccccaaccaatctgggggaaggaagggcagaataaacaaagggacctgcagactgacacagggacaagtggaatgtaatggacatggctgtttaataggaaaaggcctggtgtatcctttattgaaaacaaatgctagagatccctaagtttctatatttctaaagaattctagaaagacaagaaatgattgctgtaaaatctaataaatcaaatctctacaggaatttttactccacacccacatatcctcccagcaccccaaaacatgccttccaaggcttttgtttgtttgtttttgagatggagtcttgcactgtcacccatgctggaatgcagtggcgcgatcaaggctcactgcaacctctgcctcccgggttcaagtgattctcctgcctcagcctcccaagtagctggtactacaggcacccgccaccatgccaagctaatttattgtattttagtagaaatggggtttcactatgttggccaggctggtcttaaactcctgatcttatgatccgcccacctcggcctcccaaagcgctgggattacaggcgggagccaccacgcccagcccagaggctttagaaaagtaaatggagacagacccatttgtcagaaggaaaacagcatgtaaagcagtacttcatgaattatgtaagcaacattcccgagtcaaagcctcctaaaataacagaattgagggaaaaggcccaccgtccgaaggagttctcctttccttcttctcttgagtgtcttccgaagttttgcttctcctgagggtaaggcttgaagaacagttcacagttttaatagtactaagtcctccctcagtatacgcatcctggttctttccacgtctgtcatcctcataactcacagctaagagcaagacatctgcctttcatctcagctgcactgaaccccctgccctgcccacagtgggcactcaagagtctctttgtaaggcagaaggcttctgctttcatcccaggctcatgtgcataacaggattgtatttgttgaaagaattattatgttatctttctactctcttataactagaatatgctatatagcacattcttacgtgttcaaaatataggagtaaatattcagccaggaattcttaagctgttgcccatggttctctggagtttccattagtcccctgaaattatatgtaaagggttatctacatgtgtacatgtacgtttttcttgtgggtccacagtgttcagttatctaaaggagctcattaaccaaaaaaggaataagcactacaatttaaattatatgtagcaattactaataaatatatgtggtaattactaataaaaagagaaatccgcctttggtgaagccagcagagggccctgcactacccctcccctactccccatcaacgcggctggggctcacttgtcggctcctcgtccactcggcccacggcatcccccttgatgcgggcagccagctcatctgcaaacgatgtaggtctgcttcttttctacagcaggagaaatcaaaagaatcgcttttttgtaacaaactagtacacttcactttggacacctaacaacattatgtatacaagagcaaagaaattgaactgaggagaaaactgagtttaattaaatgaacttaaacatatgtaccctatacagctcacccaaggaatgggactcaaaatgttccttcaaagggagatgctctttatttccttatttttttaatacttgactttaatacttaaaaatctaaataagaaaataagaaaaaggtcatgggcagggagacaggagcactatggtcttcaaactctggaaccagacatattctgaatgatctgactcataaaatcataacatctggacaagaaagtggtacttgtgaggcaatttgagatgcttgccattattttccaaagtgtagatgaaatgacaaatatgcaaaaatgagagatgtacaaagtaagtcacaataaaaaataaaaaaagtcattggttctaaaaccctgccaagtgatagcaactacagccttccttacaggtctagtattttcttcaatgtcctcaatatctttctcctccttctcagagtcagcaaaaaggtcacagccatcatcatcctcttcctcatcactcacttgtgtgatgtgctaagagtataaaataccaaattagaactactagttattaagctaaagaagagatactgccacttagcctttaggctcctccttcaaaatcgtaacagctgtttaaaataataatcataatcacgatgcagtaagttataaagcaaaagatgtgctggaacaaataatacacaagatttacttcaaatctaaataaaaatgcaatctttaataagaatgtaaccacaagaatataaaaagcaaaatattaaaatatcaaaattgtctgttactagagaaatatttttatttatttactttttttatttttgagtaattttgttgttgcccaggctgcagtgcaatggggtgatctcgcctcactgtaacctccgccttctgggttctagcgattctcctgcctcagcctcccgagtagctgggattacaggcacctgccatcatgcctggctaatttttatatttggtagagattggatttcaccatgttggccaggctggtctcaaactttttacctcaggtgatcaaactgccttggcttcccaaagtgctgggattataggcatgagccaccacacctggcctattactagagaaatataaacaaaatcagtatagtcttaccttagtaagaatactgagtaatagttaaaaggtaaaagctgtaacaattagagagccatccaaggtaggtcaagcaaaaaagtgccaataacaaatccagcacgataccgcgccccctctacatacaagcatttctatggaaacagatatatttataaaagcaaagaaaaagacgtggaaagacatgctcccagagcatgatcccagttacctctgaagagtatgcagagaaagaaagtactggaaggctcaaacttagcctcatctgttaagttctaatttttccaaaggtacacagtagtatgtataacaaaaaaaaaattttgttcaatgtttgaatcaatgaactgtgccaggcatgttactaaaagcactttattatctaatttaatccttacaactttgaggttagctgcagcacacaaaaccaacctgttgcataagctagtgcttttactcactatactgtactgttttgaaaaacagtttgtggccaggcattgtgaatcacgcctgcaatcggagaactttgagagggtgaggcaggtggatcacctgaagtccggagtttaagaccagcctggccaatatggcaaaaccttgtctccactaaaaatacaaaaattagctgggcatggtggcacacgcctgtaatcctagctacttgggaagctgaggcacgagagtcacttgaacccaggaggtggaggttgcagtgagccaagatcgtgccactgcactccagcctgggcgtcagagtaagactctgtctccaaacagacaaataaataaataaatgggctactctattcaggagaaattcagattttggagtcacaatgtttcagtgataaattccagggtgtgggacgtagattaagggtgttaagttcgtggccactgaagttacccatgatggtgttacataaaatccaagtttggtaattggctcgcctcaattttaccaaccaagttccaagttctaaagtgtgtatgtgtgtgcgtgcgtgcgcgcgcgcgtgtgtgtgtgttttaatgaatgtgggggaagtggaagaggttggtagatggtgacttaaaaatgaagtccccttaagactctaagactgtttttgcagacagcagtcttagtcttcttccaggctggagtggagtggtgcaatctcggctgactgcaaccttggtctcaggggctcaagcgatcattccacctcattctcctgagtagctcgaactacagatctatgccgccatgtccagctaattttttttttttgtagatatggggtttcaccatgtttcccaggctggtctcgaaccgccttggcctcccacagtgctgggattacaggtgtgagccaccacgccagcccagccttagtgttaacactgttataggttactgtaacatattggctcacagtgtgtgttctcgggtctgcctctttcctggttacctaatcataagtaagttacttctcctttctgtacctcagtttcctcaactataatttggaaataatatttcctccctcatagtcattgtgtgaattaaatgaacaatgtataaagtggtaaatactgaacacttgataaatgttagctattattaaaggagagactgatatttaaatgattacaatacaatgtaataccttaggataaatacatcaaaaacaacttttttccttatttattttacagctttattactgatttccctctaaaaagagacccaaataaatgtggagcgactcattatagagtaaggaatcacaaagtaccatagtcacgtaacaaaagcaaaaaaaaaaaaaaagcaattgttttacctttcaactgctgatgttatgtacaatctatcacaagaagcatagctgtgcattcatgagctgattgtattaacctctagaattttagaaacgagcacatctaagcatgtggatactctcttaccttacaaagtaaaagcaagcattttctattttaaaatttttatatctgtgtaaaacgaagaattcctggaggtcaaataagaaaaatataccaaactcaaaacactattaagtcatgaaacgaagactctgaggtagaagtcaagcaatataatccacaatttcaggtattcccagcaaccatcgcatctcgcaagtaagatgtatttttttttaaagtctcaacttccaaaaaatcaataatccattctgtaaaatcagatgtaaaactatgaccgagccgggcgcagtggctcacgcctgtaatcccagcactttgggaggctgaggcgggcggatcacgaggtcaggagatcgagaccatcctggctaacacagtgaaaccctgtctctattaaaaatacaaaaaattagccaggcgtggtggcgggctcttgtagtcacagctactcgggaggctgaggcaggagaatggcatgaacctgggaggcggaccttgcagtgagccgagactgcactccagcctgggcgacagagagagactccgtctcaaaaacaaacaaacaaacaaacaaacgacaacaaaaaaaaccaactatgaccgacagaagacacccaaacttttgtcgtggtaacacagtaaatgcttttactaaaagctgccaacatttctatcgtaagggggcagctggttgtaaccttaatgtccatattggtcgggatagtaaggttcttgtctgtgttgcgggtaattgttaccgcaggattgtccacgccactgattggatcgattgtcacttggccacccccatctgccgtccctgcctctgaactgtctgctatcttgcaaccgattgtctctgtttctttggttcccaccagctctgctattccattcctcaacaattggagaggactcaggagggcgtttcaagtattcctgatactcctcgtcatcttctgtgaatctactagcaaacatctcttcaaaatttggaacagctttggcagtgtcagtcattctgaaattcccaaagatttgaggcagctgtattgtttaatgtttaggttgtttaaatccgccaagggctgtgtctatctagctcgggccgaaccccgccagcgagacactaagagaccgcaggagaggtggcctctggcccaccacaccgtggaactccagaccaccccagctctccaatgtagcggagacccttccgctagccatagaaaataacttaagtcacttaagctgtacttggggtaatcaggttatttaatgaggtgataactgaggtgactacaaaagaaaagtctgggattgggtgtgtgagcaaggtgcatggggacagtggtatgttctaggttgaaggctcaccctaggccaagcaccgtggcacctgttttacaatatcataactttaatatcacatccttgcaagatatgtagcttcgttttactgaggaaagctcagaaaagttaaataactcgcccttgggcacacatgactggaaagaaattgggatttttattttagtaagtaagttggtcaggcacaagggcgactcagcagagggaacttcaaggaagtgtgagacaacagctggagccctgagctgggagagtggaggacgaattataaagagttttatgcctgccataatgagaagcttgtccttgaacttgaggggaatgctgagagtgcaaaggactttaagcaggccctacacagtggcagccaagcaggtcataaagagcaagatgatgcccaggcagatcagggattctcttatctacagagcgtccgcctaccagctccttcacagcagcggattttgctgcaagagaagaggcagcaggccaggccttttccttcgcccacagcgcctacgtcgaaggctcccaggctggttgctccactggctgcttgaggtcccctctctccagacccgccgaactggcggccggtgctttggccgatcccgcgccgctgcctcgggccttgggcggcagcgccccccgcccaacccgcctctgcagcgttcctggcgtcagcccctatcctccagcttcctccgccccaacctagggtagaaccccaaactccagtcccagtccacttccgcagcttcctcccctcagcatcgcaggtcggatcacgtgcgggttctgtcacgtgacatcaggtcacgtgaggccggtcacgccccgggcagcttggctggggctaggcttccggggctctgcggtcctcggcctgtgctggcagcctcggagcccaccgagccgggcggctgggatggtgagggcggcgggccggagaggggccggcctgggctggggccgccgtccctgccgccctcaggctcagcctctcttctcgtttttttcgctgcagatgaaccggacgacccccgaccaggagctggtgccggcgtcggagcccgtgtgggagcggccgtggtcggtggaggagatccgcaggagcagccagagctggtcgctggcggccgacgcgggcgtgagaggcgggccccggggacgcgagagcggcaggggtgacgcttggcttgcgcgcaggagggccggaccgcgactgcccctgcacctggcccgtcccgttgcctgccctcttaggaacacacgccccgtttagcccccgagaatgccaccctggcagtccccggccaccagggagaggggcagaccctgaccgtggcccagacgcgacgttcccttcatggggtttctggctcagctccatccggaggggagatccgtttccgccacactgagggattgctcgggcactagggaggcgattcctgttgggacctggactaaatggggtgggaaacaagccagtatgtggatatcctttaatgggattcttcaaatcgggggcccaaaaagctcagaactgttcgagtcccaaatgaataggatttttgaataagagtggtggttgattagctaacccttggtctgtgatctctgtagattgacaaccaaagaggacttttaaaaggagacagggttttgccctgtcgcccaggctggagtgcaagtggctcgatcttggctcactgaatcctctggggttcaggtgatcctctcacctcagcgtcctgagtagctgggactataggcgtccaccacacctgtctgatttgtttatttatttaattttagtagagatgggggtcttgctatgttgcccagactggtctgcaactcctggactctagcgataaccctgcctcagcctcccaaagtgttggattacaagcgtgagccaccatacccagtgccaaaaagggattttaaatttttccagaaacgagataggtgtccattagctcactgccactcttttgatgagctttcttagtgttttccaatgtcacttggttttagtacttgtcaaaccagcattccggccgggcacagtggctcacacctgtaatcctagcactttgggaggccgaggtgggcgaatcacgaggtcaggagttcgagaccagcctggccaacatggtgaaaccccgtctctactaaaaatacacaaaattagttgggcgttgtggcgggcacctgtaattccagctactcgggaggctgaggcaggagaatcgcttgaacgcgggaggtgcagtgagccgagatggcgccactgtactccagcccaggcaacagagtgaaactctctctcaaaaaaaaaaaaaagcatttctttcacattctaacactcaaaggtgaaaggaaatgggttcttttttgatgtgacatgcagaatagttacatgtaacattgatactactgtatgtttattttttaaaatagctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatgtgagttatttagttatattataattccttttttgggagtaggagatattgtaattttaaataacttactgttaggttccctcctaaattttggtggaagtgtggttcttggtaattgtagcttttttctctgggattaacgcctcttttttatttgtaaagttttaagtccttttttccaagcctctaaaaaagtctaatgataaaattttcttatacttcagtgcttccatcttttgtcgttttgagagtagtcagcaattgtgctgaattgtgtggcactcacactgcctttgttgtggcgtgatctgtaaggacagctgtttacctggttagaccctctggacaccagcatatggtttcagttgttgattggggtcattctgttctgataaattatattcaggggatatatatgtctgcttgcaatattctcaactaaagtttatgatggccgaacttacaatatggaatcaactgtaaacagattactgagcttaaatctatgtgtgatttctgtctatttactgtttcttctaggtggtaggaatacataggtaaattagatagagcctctcccttggcaaatagtataattccagcatacaaaggaagtaagtatggctggagcagagtggagacttaagagatgaggatggagaggaagcttaggtaacagacctgtgtttctcatagggtgtcccaactttctgaatatcagcattcatttgtggaaaaaggattattaaagtaagcgatctcccgagattgttagatataaagtaataaaattttcagaatcacaaaattattaaaaaagcccaagatttagaatagttaagagaatgccatgtagtcaacttgtgcagcatgtttgtgcattttttaatagctcaagttaaatgccacttcctgtctttttttggagagctatatataaaataaagacattaataaaggtgttagagatctctttgccagttatttcctttaacagcaaaggagtacttatgagtttgaaaaataacaagtattcggccaggcgtggtggctcatgcctgtaatcccagcactttgggaggccaagacgggtggatcacctgaggttgggagttcgagaccagcctgaccaacatggagaaaccccgtctctactaaaaaaatacaaaattagccgggcatggtggcgcatgcctgtaatcccagctacttgggaaggctgaggcaggagaatcgcttgaacctgggaggcggaggttgcggtgagccgagatcctgccattgtactccagcctgggcaataagagcgaaactccgtctcaaaaaaaaaaaaaagtattcaagtaaaatcagtagttttctgattgtttacacagaatgtccatgcttggtcctgactatctcactggaaaagtcagggactctagactcaacttctctggtgtgcacagccccataatgttttcatcaagattaatttggtgtccttttaagcactcctgttcttttcattctgtacttttcttgctggatcaggtagtcagcacttctctgcagtcagtgctgcagcaccagagtcccaaaggatttgggaagtttctttttttttttgagatggagtctcactctgtcacccaggctggagtgcagtggtgcgatctccgctcactgcaagctccgcctcccgggttcacgccattctcctgcctcaaccttccaagtagctgggactacaggcgcgtgccaccacgcctggctaattttttgtatttttagaagagacggggtttcaccgagttagccaggatgatctcgatctcctgacctcgtgatccgcccacctcgacctcccaaagtgctgggattacaggcctgagccacggcgcccggcaagggaagtttactttgtacccagtgtgcctgtaccagattggtactagattggtaccagatcaatacttcagtgggaagaaatggggaacatcatacaatttttctcaatcacagtcttaggtcttatcttttctccagctcttttctagccaagttttcgtagattctgagttttccatgttgtagtttttgtggagtttttttggttttgttttattgtgttttggtaattgttctttatttctgtccaatactggggatttcctgttttccatccatctctccatccctttagccttagcttttttttttttcttccgagacagagtcttgctctgtcatccaggctggagtgcagtgacaccatctcggctcactgcaacatccgcctcccgtgttcaagcaattctcctgcccacacctcccatgtagttgggattacaggctcccgccaccaggcctggctaattttttttctatttttagtagagatggggtttcaccatgttggtgagtctgcttttgaacttctgacctcaagcgatctgcccattgcaacctccgcctcccgggttcaagcagttatcctacttcagcctcccaaagtgctaggattacaggcgcgagccactgcgctcggcccttagtgttaagtcttgatgccccttcgccttccagtctgcagccagaactcttctccggatgtgctggttgccgctgccaaatcttaattacttcccagaccttccataaggccacatgctataggtttttttcatttgtggcaaagcatgataatactgagaaaacagctaatgcataataaaactctgaaaaaatatacttgctgatatatatttgtaagtgatctggctttttttttttttttttttgagacggagtctcactctgtcgcccaggctggagtgcagtggtgcaatctcagcccactgcaagctctacctcccgggttcatgccattctcctgcctcagcctcctgagtagctgggatgacaggcacccgccaccacacctggctaattttttttgcatttttagtagagatggggtttcaccgtgttagccaggatggtctcgatctcctgacctcatgatccacccgccttggcctcccaaagtgctgggattacaggtgtgagccaccatacccggcaatctggctttttaatgttttattttcaatccctgacatcagtacttaggtgttacaattccagcttgaattatggtgccatttggtttcatggtaatttatcagaaacattcaaagtcagataggtttctgggttttattaattagcctcaggggcagccacaaagttgcaaactatattataaagttagtgaaacaatccgtactttctagggcgagaacagtcaggactttttagggcaagagaaattagtaccattagtaaaggctcaagaggggacttggagggagaagaaatactaattaacattggccagtgttctagtgtctaattagaaggcaacacaattctaaaggcttaattatctgttaatttaggaattggatcctgaaatagcaagtgccatagttaatgactttagtttgttaaatgaactggtgagggaggattttttctttttaaagtcaattgtttcaaaatcttagctttgtaaaattaaaaaaaaaattccagaatgaaacaaattaacctgtttatgcccaaggttagaattttttttgtgaaaagccagaccttggcaatgaccttgagcagtaggatatacataattctgacaagcttagtgttccaataatgggacactaggcataaatgggttaattttccagatcatcttcctgttgatttataaaagctgaattttggtcatttttccctccttttctacttttctattgaagaaacagatggagttgctgaaactgtcaagtactcagcaattagagagaaggaggtaaagcccaaaagccttattaacatataatttcctgcacaggtttttccctctccccctagacctgctttattttacataatgccccttgcttttgacactccagccttctcattccttggagatgccatatgccctgctgctacggggcctttgcttacattgcttcctatgcctctaccctttgattgacatctgtctgtcttctaggtctctgctcaattatattacttcctcctggaccctctgcactaggcacaccccctggataaaagcagctgaagcatcacattctttagtagacttcttacaattgtaattttacaattattgatgggatttgatgagttggaccctcccactaaatcaagccccatatttttaacaacaaatatatttgaggggtccagcacaagcctgatatttagggatccagtgaatatttgaatgaatgagagtacgcataaatgaaaggggaccagggctgtgtatagtctgttactctccagccctggtccctttttccccagttcccctctttccccttttaccctgtctccccagatgaggagcaataccaaagatatttaacagtcctgggtatagctatctgactgtaaattgatcacaaaacacatgaagctgtgagtttagcaggtgaggatgaaagaagttagcattggttatctgctggatatgaagtacttgaggatgcatagtcctgctcaccctgaaaagatcccatgggctttaggtcccatgggtttaggtttcttagatgtcatgtttggctttctagctgcaggctgctgatgggtaaccatggtagctgccaggtcttaaagtctcacttttgagatttacttaactttttggagtcctgactttgaaaattaccaaagtaatccctgatctttatagagcaattaggaaaagtaagaaaaagaaaaatcatgtgaaatttcctcagcttgaggggagcctctcaacgtttagcacatatattctaagtccatttcccatgcagacatcaggcttaaaagaattgaacctacagtaggccgggtgcggtggctcacgcctgtagcactttgggaggccgaggtgggcggatcaggaggtcaggagattgagaccatcctgactaacacggtgaagctccatctttactaaaaaatacaaaaaaattagccaggcgtggtggcaggcgcctgtagtcccagctactcgggagcctgaggcaggagaagggcatgaacccgggaggcagagcttgcagtgagccgagatcccgccactgcacttcagccagggtgacagagcaagactccgtctcaaaaaaataataataaataaataaataaataattgaacctacaaaaaatcagctaccccaaattaaccaaccattgaacttttcagtgtatttttttctgttcttgttttttaactttaaccttttctagatgactgtgtgtgtgtgtgtgtgtgtgtgtgtattttcatttgcagcctactttttttcttaatgtgaacttatttaacccatctttgagacttttgtgaatttaatttttttgttcttaaaccgtatcataatttatttaataatcttctaatattaaatgttatttatgaaatgtttcataaatttcataaatgtttcataaataaatagaaaagttcagagagaaaccacaagtgctaagaaaatgtagcacctagcatcagtggttttgtatcttgccacatttgcttcaaaggtgcctacccaccatattcgtccttaactctaatcattttgggtggggattccttggtatctctgcctttttattctttttttgtttttgagacaggatctccctctgttgcccaggctggagttcagtggtgcagacagctcactgcagcctcaaactcctgggctcaagccatcctcccatctcagcctcctgaatagctggctaggaccacaggtgttcgccaccatgcctggccaactttttattctttttacctagagagggatttcatttttatcccttatagataacctttattgtgtagttgttcttttcttcattgactattatgtatgaatgtttgtgtgtgtttatgtgaaaataaaatcaggcctccatggaattgtgggtctgtttctgccctctgctgtttgttttgtttctctgctgtttgacagtatcataatcttaaatactgcagatttctaatgtcttattagggcaagtccccataatctgtttttattcagaattgtcatggttatcaatctttggctttttacttttctgtgtgaatttgaggattatcttttacttatttatttatttttttgaaatagagtttcagtcttgttgctcagactggagtgcaattgtgcaatctcggctcactgcaacctctgcctcccaagtttaagcgattctcctgcctcagcctcctgagtagctgggattacaggcaccggccaccacatcaagctaatttttatatttttagtaaagatggggttttgccatggtttcaccatgttggccaggctggtctcaaactcctgaccgcaggtgatcccaaagtgctgggattacaggtatgagcctcccaaagtgctgggattacaggcatgagccactgtccccagcaggattatcttactatattgtgccacagaatattttattagcgtttgattggaattacatagaattataaatttggtatttgtgactttctgctggaaatcatgataccatgaacattctgatgtttgcgtttatgataattttcatgggagctaaatttcaagaagtagaattttgggtcagaggatatgatcatttaaaagcaacattgtttgatcagattggcagatacttaaagatgggtggacaggagccattgctggcaaaggtttgggtaaggggcacttgagtatgctgctagtgacagggaattctacgcatttgtgcatagaatctgggaatgactattaagatttatttattccctctctaggtaaaatccttctctaggtatataaataaataataaataataaataaataatcagtttcagccaggcacaatggctcacacctgtaatcccagcactttgggaggccaaggccgatggatcacttgaggtcaaggagtttgagaccagtctggccaacgtggtgaaaccccatctctactaaaaaaaaaaaaaatgcaggccgggcatggtggctcacacctgtaatcccagcactttgggaggccgaggtgggcgaatcatgaggtcagattgagaccatcctggttaacatggtgaaaccccatctctactaaaaatacaaaaaaaattagctgggcatggtggcaggcacctgtagtcccagctactcaggaggctgaggcaggagaatggcgtgaacccaggaggcagagcttgcagtgagccgagatcgcaccactgcactccagccttggcaacagagtgagactccatctcaaaaaaaaaaaaaaaaaaaaaaaaaaaaaaaagggcaaaaacaaattagccgggtgtggtggtgcacgcctgtaatcccaattacttgggaggctgaggcaagagaatcatttgagcctgggaggtggcggttgcagtgagccaagatcctgccactgcactccagcctgggtgacagagctagactctgtctctaaataaataaataaataagcaggaagggtaggagagctctaaatatatgcacgtgttagcttatatttgtgttcagagcctcaggaaatgagcatacacaccaggcttaaattgggtattccaaggatcaggttggggatagggagggaactattttaaaatacatctcttttccatgtgcctttatattgacttaaaattttaaaaattgagatagaattcacataccataaaattcagtcctttaaaaagtatacaatttggtggtttttactgtactcaaagttttataatcacggccactgtctaatgccagaagattttcatcagttcatttatattgacttcttatttctttctttgtaaaaaattttaatttcatttcattttatttttgagatagagtctcactttttcacccaagctgcagtgcagtggtgcaatcagggctcactgcagcctttacctcccaagctcaagagttcctcctgactaagccccacaagtagctggaattacaggtgcacaccaccatacctggctaatttttgtattttttgtagagatgaggtctcactatgttgcccaggctgatcttgaactcctgagctcaagtgatccccttgcctcggtctcagagagtgctggccttacaggcgtgagccaccgcacctggcctatattgactttttataacaagcatgttgtacttcggtagtttttaaaacataaaaatgattttaaaaaccaagaatcacagtgatttggcagagcagtgggtcttttctggaaaagagagtcttgcctacccatgctgtcagggttagtcaaatgcccaggctttctggcaagtcagtggtagatttttctctctgctttcatacaaatgggataataaaaatttatcagccattttaagcaactgaatgaaaataagttttgcctttaccattttccttgttcaaaatcctgaagttctagtttcctagttgataaattacatcagttgacattctccataagctggggtcagaatactgtatcattgcccatcaacattattaggttaaatgaaaaggtgtgaaaactgatatcttactgtttttgcaactcttggtttacaacgaggttaaagtttcatcatgtttcctagtcatttgtatttaaattttttttttttttttttttggtgaatggactattctttgctgttagtccatgacccactgttacggacacccacctggtagtggtctcagccctttgctgaataaccatttccttccgcatctttgtccttagttactgtgtgaattcttatattgtgatttatttccaatgacgtgttgaccttttaacattgagtttgcttccatatttagcgtgtatatgatgaagaagtggaggagccagtactcaaggctgaggcagaaaaaacagagcaggtacttgtataaaatcactcttagctgagtttctgactttgaaaagtgtggtggagatcgatgtgttatgtgggaactgggggatggtgggtggggttgggaaagggagggactgctcctgacagcagcccaagaggggattctttcctttgtttctgaaatgtagtatattaactaatacagagatcaaatccttgaattctgatataagaatagagtagaagtcagcaaacttcttttgtaaagggccagatagtacatattacagatttggagggtcacagaggtcatttttttcctgtggcttcctgagttacagatggaccagccttcttcctgagatcttctcacaccagagcccaaaacatagctaagaggttctgggtcacactgacttcttagcactccagcagagatttctttttcttccactcaggaaggcacatggactgtgaataagtttattattggagtagctttgattttgttctcatttattcagaaaatatggatcacctgtaaaggttggccctttgtcagcaattattacttgtaacagatgaagctgttagactaggaaaagggtattcaaaaccagctatagttctgcctgttgccagcatttttttaaaaaagttattttattttattttttatttaaaaaatttttttattttgagatggagtctcactctgttgcccaggctggagtgcagtggcacgatatcagctcactgcaacctctgcctcctgggtgcaagtgattctcctggctcagcttcccgagtagctgggactacaggcgtgtgccaccacgcctggctaatttttttgtatttattgtagagacggggtttcgccatgttggccaggctggtctcaaactcctgacctcaaatgatccgccagccttggcctcccaaagtgctaggattacaggtgtgagctactgtgcccagcaggttattttatttttaatagaactcaaggatttgctagccatttaagtgcagtagtatctggttataccaattcagggtttaatttgaaggtgataggtatttagtgtactatttttaaaaactgctatatatttcatacacattttcacaaactcagtacaatattagctatttaactcagaatcaagcatatccaaatagaaaaatacacaaccaagacaaaaaagttcagttagaaagacttcagtacttgagataaaagactaaaatgctcgtagggtttttttttttttttgcctttggccctcagaacaacactgtgtggtttggttccttctagaatatttgtagagggggaaatgacactaaatatttttcggtatttctcacaatggcacacttgtgtctgtggggactgccattgagaactgctgttgcaggaagaagacacctgagggagattctcagcctgttggtgatatgaacaaaccttttttcttgaatggggcattgttgtagggtatacacagaatagaccggagatgaaaatgacccccttttgatgtagaacagatttataaaataattgtaattgtccagttttttttttttttgtctctttaaactgtaattgaaaaatgagacctctgtgaccttccttctaagtcttaacacctaaaattacccaagggataaccagggctcgtgggatagtcatggtgagtctgagagtctaggccctccagcagtggggaaacagcatgcattcattgttgggatacttctccacacactagttgtacctctgcttttgtagacgatgacccttgagctctggaaccttaggtagtttgatgcatgtccagaaaggggcaaacttgggatttaaaacttgcagtcttactccaaagtctgtgtcaaggcattcagcagaatttgacttttttaacatttttaataagtttttttggagcttgaggctaggctttagagaacattcacagtattcttttggggcagtatcagtatattggagacccatactgcatggtatttattttgtaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggtgaagacattcaacttaaatatttattgcacaactattatgtttgggctactttaattgggcacacgattagtaagtcatggacttaacctctgggaagtgagtatgtcacttagtagtctcacattgactccaccagaaagactcgctttacctgagcactgatggagtacttgtgaggtgcaaggcaacatgtcaagttggggtgcaaagatgcagagcatggcctctactctcgaggtgtgtgttgcagtctggtgggagagaggagacatacatacgaataaccattgtaaatgccctgagagagaattgatttccagctggaattttggggcaaagatgatatttgaattggggtttgaagggtggggaggctcaaaagagacagagagtgttgggaacctgaaattatgtagcttgggctaaggaagactgcagaagaactgaaaggcatttgggttgtttccggtttgggcaattattaaatacaaatgaagctgctgtgagcattcatgtccaggctccctcatagcctagtgagtgttggttgcttgacacactttctcccacattgttcaaagagacaattggggtgacacagagtctctcggtagtgaacacagaaagttaccacagtgatttatagaaagaggccttgtgacacacaaggccttccgaattaaaacatgccacagaaccaaacccttttttttttttgagacggagtttcactctgtcctccaggctggagtgcgtggcacgatgttggctcactgcaacctctgcctcccaggttcaagcgattctcctgccccagcctcccgagtagctgggattacaggcgcccaccaccacacccagctaatttttgtatttttagtatagacagggtttcaccatgttggccaggctggtctcgaactcccaacctcaggtgatccgcctgccttggcctcccaaagtgctgggattacagacatgagccaccccacccagcctgaaccactcttctagtcattctgtagctgcacatttctcttccagtttgagctttgctgagtcacaccaaattgaggcagatcatttggcactgaccagtacacttgctgcttggattttcactgtatgcctttaaaagtcagcagtggactctgggaaatggattgcctggaccacacttgatacttccaagacacacagcactttctcccttttttttttccccttgcagagaaagttgtggaggtacacttttcttttgtaggaggatttggggatgtcttctgagtcagtgagaattagtccaaattaacgctgtctttgccttatgctccattggttgctgtgacgtcgttgaacctttactttaaccttcccaatctttctgttgttgtgtgaaacgtcagaattattctcccctgccccagagtcctttgacaaggaagagatatcattgccaaagggcaatgcctcacaggggacagggcagcatttccttcagcagtggaggtaggaggctgtgcaagggtggagcactttcttgaccctatttttttttttttttttgagacagagtttcactcttgttgcccaagctggagtggcgcaatctcggctcactgcagcttctgtctcctgggttcaagcgattctcctgcctcagccttccaagtagctgggattacaggcatgtaacatgacacctggctaatttttgtattttttagtagagacggggtttcaccatggtgaccaggctggtcttgaactcctgacctcaagtgatccgcccgcctcggcctcccaaaagtactgggattacaggtgggagctactgcaaccgaccaaccctaaatttttaatgtgtgtgtggtgtgggactgacaggagtagacggctgacatgggcagatctccagcatgtgctgttggggccacagtctcctgccctcactctgttttctcatctggtcttattttaccaacttcacttttctaaattcaacagtgtggaaccactagggggtattgttcttctgtttattgagttataatcttttttatttatttatttatttattttgagtcggagtttcgctcttgttgcccaggctggagtggagtgatgtgatgttggctcactgcaacctccacctcctgggttcaagagattctcctgtcttagtctcctgagtaaatgggattataggtgtgcgccaccacacccagctaatttttagtattttcggtagatattgggtttcaccacgttggccaggctggtctcaaactcctgacctcaagtgatccatctgcctcagcctcccaaagtgctgggattacaggcatgagccactgtgcccggcctaatctatttttatattaaaatatatagatatattatgtctcattagtactgctttttaggggacagctcaccagaatgttcagtttctttccttggtcctcctcttcttggaccttatactaggaggttgtacccttttccctgtttgcttgctgctgatagacttttggtaggcttttgccatttttgttaaattttgttaattaggcccttggggagggagattctgtgtgatacagctttactttggcatcttttttctttttttttttttttgagatggagttttgctcttattgcccaggctagagtgcagtagtgcaatctcagctcactgcaacactgtttcctgggttcaagtgattctcctgcctcagcctcccgagtagctaggatgacagttacccgccaccatgtcccgctaatttttttggatttttagtagagacggggtttcaccacgttggtcaggctggtctcaaactcctgacctcaagtgatccacccgccttggcttcccaaagtgctaggattacaggcgtgagccatggtgcccggccttaccttgacatctttacctaggatttgacttttaaaaaaatcagtgaaaaaaagaattttttttttaacttttagtcctgctgtgtttcttattctccaccttcgttatgtagcttgtttgggatagtcagatggaacagggtatcaggtggcacatgtaagtttgttttcaactgaaatgtttgacagcctattcctttcatcatgtacaggatctatacattgatcgtcctttaccatatctcattgggtcaaagctgttcatggaacaagaagatgtaggtcttggagagctgtccagtgaaggtacttttcttcaccaaataattttattccttaacatttcttttttattttaaaataatttcaaattttacattaaagtttcaagaatagttcaaagaactctcatatacccttcacctgggtttaccagttaacatttcaccacatttgttagattgttctctacatatacgtaatattttgtcttgagcctatttgggagacatcatgctcatgccctgttacttctaaatgtttctctgtgtgttttctttttttcttttctttgtctttttctttttttgagacagagtctcgctctgtggcccaggctggagtgcagtggtgcgatctcagctcactgcaacctccgcctcccggatttaagcgatttttctgcctcagcctcctgagtagctgggaccacaggcgtgcaccaccacacctggccaatttttgtatttttagtagagatggggtttcaccatattgtccaggctggtctcgaattcctgacctcatgatctgcccgcctcggcctcccaaagtgctgggattacaagcatgagccaccgtgcccggctctttttctttctttctttctttcttttttgagccggagtttctctctggtcacccaggctggaatgcaatggtgcgatcttggctcactgcaacctccacctcctgggttcaagcaattctcctacctcagcctcctgagtagctgggattacaggtgcccaccaccacacctggctaatttttgtatttttagtagagatggggttttaccatgttgggcaggttggtctcgaacgcctgacctcaggtgatcctctgtgtgtgttttctaagaacaaggacatctcttgtataatcacagtagaattacaaagccaggatattttcctggacataagggtattatccaatctgctgctatgttcacattttgccgtttgtcccagtgacaccctttacagtctctctcttttgttctgtggtccgggactcaatccaggaccagccaccacatttggttgtcaaatcttcagttatcttttaatctgatgccatttctcagcctttctttgctttttatgaccctgacatctttaaagagtacaagcaagttttttttttatttgtaatgaataatttttggggggagagatacttcaagactacataaatatgtaattcctcaccataatgacactttcaattccagtaagtgggtatagatggttttatcaagatctctgtgatgctgttgtatggtggtttgtgattttgagctaaggacattttcttgtgaatattggtgtggtgacccttatctctcttctcaacagaaggctctgtaggcagtgatcgtggcagtattgtggacactgaggaagagaaagaagaggaggtaagggctgtttggtatgaccaggtcacggtgggcagcaagcttaatttaagatgggcctagcaggctaagtaaatagcataactgtgaattcgtaatctgcttccataaagcttttaacagtgatagaagccacattctgagttttttttcccaagggttagatttcctttttgccttatgtacaataatagggaaagctgctttcatctcttccactattatcctctctcccaccttgccaccaaatatctctttcacccaatatatttttgagaagggcagcttagatgttttggtggaatctctgcctgggatatagtctttgagtatattccgtctttgaataattctaagggaaaaaatctacatttagaacttttgtaaactataaaacctagagcaggatataccgaaagccaccacttacattctattttgctgctgccgctagcgctttcatatccacagagcataatttcatttccttgtctagagtttgagtctgtgggccttgactacagttgaatctgtagttgttctttagatgggatattcgttattggaaaggacacagccatgttgcaggagagtcctcgagtatgggatttccgaaaggagacagtgttgtgtatgtgcttttctcttctggttggtccccctttctgcactctccctgcccgcctttcttccagtcctccaaagaaaaacctgacagcaggaaatgagcttttcttaagtaactttcgtataacaaaagcagtgctcattaggggaatcccttgcttttagccaccgatgtggcacttctatgtggcacttcatcaatagttgctcgtagcaactattgatgtccccttcttgggcctaatgaagtagttatttttattttttatttttattatactttaagttttagggtacatgtgcacattgtgcaggttagttacatatgtatacatgtgccatgctggtgcgctgcacccattaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctattattgttggacatttgggttggttccaagtctttgctattgtgaataatgcaaggaaatagagacagtatagtccaaaatgtaaaataacacaaactgactttcagtaatttagttagttaaatgtgcaactctttaaatccaaaggcaagagttgaaagtgcaggtgatgtgaacaaattgttagaggcatttaagtgaaccacaaaaattacatgttaactggaacaacccttcacaatattgccagctacccagcttatctgcaccttgatacttaaggtgaccagtagtcagtacaaagagactgagtgtcagagctttttctccacttgacatagaatcagcctgccccagagacttagacctgcaatcatttctgtgcttctaagtaaagcccatttaacaacaaagccttttcttacccataaaggagtcagatgaagattttgcccatcacagtgacaatgaacaaaaccaggtaaggctcatatattgaaatgactttgtttttacattttaattgaagcatagtatatatactaaaattactttggaatgatttatgaccaagtgaggattttttcatgtatacaatttattttcctttaagcatttcatgtatttaggctaactacctcctttgtatatattttttccaattttgctttatagtttatttttcttagaaaagaagtttcaaagaagtgaaaagcacaattggaaaacagagcctctaaaagaagactcagttacccaaactgaactactttgcatgagtccctcttctgttttaaaattggagacaatctagcagtaacattattgagtattcacaagatgaaaacttcttaccctactgtcttagcacggttatcttaatttttgaatatctaaaggcgtattcttttcatagtgtgcatcgttcattttctgccattttatgttaacattttataaatgtgtccttatttattattattatttttttgagatggagttttgctcttgttgtccaggctggagtgccgtggcgtgatctcagctcactgcaacctccgcctcctgggttcaaataattcttctgcctcagcctcccgagtagctggcattacaggtgcccaccaccatgctcagccaattttttttgtatttttagtagagatggggtttcaccatgttggccaggctggtctcgagctcctgacctcaggtaatccacccaccttggcctcccaaaatgctgggattacaggcgtgagccaccatgcctggcctccttattttaaatagcctttgcagtttgcgttgtaaacttctatacttttaaacatactgagtatgatactgtcatagtctctaaatgtataagggaaagagtttatttctagagttgtatttttgatgtaataatgtattcaatattttcttttcttttttttgagacagagtctcgctctgttgcctaggctggagtgcagtggtgtgatctcagctcaatgtaatctccgcctacagggttcaagcgattctcatgcctcagcctccctgagtagctgggactatgggtgtgtggcaccatgcccggctaattttttgtatttttagtggagtcagggtcttcccatgtttcccaggctggtcttgagctcaggcaaaccacccactttgccctcccagagtactgggattacaggtatgagccaccacgcccagccaatattttcatatatagaaatcctttgcttcggtgaactgtttcttcagaatgaggtggtatagagttatgttaataactcttaatgtctggtggacattctaaattaagtattatgcatgtagattttcctacaatctcatcactggggtgattattttaaatttcttttagttaaaaatttgcatttaaatttcttaactgggaaatatttttttcacaaaaatgtttaactatcaaatgaaggattttatactttctggttgttactgtattttcctggttgtattcataaatgtggttgatctctataattttaacgatcagtctttcttcataggatatttgtttctatggaatttcctattaagatctgtaaatgcaaacagtttttctttccttttttttttttttttttttttttgagacagagtctctctctgttacccaggctggagtgcagtggcacgatattggttcactccaacctccacctcctcggttcaagtgattctcatgcctcagcctcccaagtagctgggattataggcatgtgccaccatgcccagctagtttttgtatttttagtggagatggggtatcgccatgttggcgcggctggtcttgaactcctgacctcaggtgatccgcctgcctcagcttcccaaagtgttgggattacaggcgtgagccaccacgcccggccacaaacagtttttcaaaaacagtacagtatagtgagtaaaagcactagcttatgcaacaggttggttttgtgtgctgcagctaacctcaaagttgtaaggattaaattagataataaagtgcttttagtaacatgcctggcacagttcattgattcaaacattgaaaaaaaatttttttaattatacatagtagtgtgtacctttggaaaaattagaacttaacagataaggctaagtttgagccttccagtcctttccttctctgcatactcttcagaggtaactgggatcatgctctgggagcatgtcattccaagtctgtttctttgcttttataaacacatctgtttccatagaaatgctgtagtgtttgcagagggggcggggcttggtatcatcctggatttgttattctgcgcttttttgcttgacctaccttggatggctctctagtcattacagcttttaccttttaactattactcagtattcttactaaggtaagactatgctgatgatgtttatatttctctagtaaaaggctgggcatggtggctcacgcctgtaatcccagtgctttgagaatgtaatcccagcgctttgggaagctgaggtggttggatcacctgaggtcaggagttcgagaccagcctgcccaacatggtgaaaccccgtctctaccaaaaatataaaaattagccgggcgtggtggcgggtgcctgtaatcctagctactcagagggctgaggcaggagaatggcttgaacctaggaggcggaggttgcagtgagccgagatcaccccattgcacttcagcctgggcaaaaagagcgaaactccttctcaaaaataaataaataaaaatatttctctagtaacagccatttttgatattttaatattctgctttttatattcttgttgttacattcttataaaggatacatttttaggccgggcttggtggctcacgcctgtaatcctagcagtttgggaggctgaggcgggtggatcacctgaagtcaggagttcaagaccagcctagacaacatggtgaaaccccatctctactaaaaatacaaaaaatttgctgggcgtagtggtgcatgcgtgtaatcccagctactcggaaggccgaggcaggagaatagcatgaactgggcaggcagaggtttcagtgagccgagatcgtgctgatgcactccagcctgggccacagagcaagactccatctcaaaaaaaaaaaatatatatatatatatatatttatatatatatatatttatattttatatatatttttatatattttttttcttagattcaaagtaaatcttgtgtattatttcttccagcacatcttttgcttcataacttgctgcatcatgtttatgattattattttaaaaagctgttacttctttgaaggaggagcctaaaggctgacagtatctcttctttagcttaataactagtagttctaatttggtattttatactcttagcacaccacacaaatgagtgatgaggaagaggatgatgatggctgtgacctttttgctgactctgagaaggaggaggaagatattgaggacattgaagaaaatactagacctgtaaggaaggctgtagttgctatcacttggcagagttttagaaccaatgacttgtttttctttttattgtgacttactttgtacatcactcattttggcatatttgtcatttcatttacactttggaaaataatggcaagcatctcaaattgcctcacaagtaccactttcttgtccagatgttatgattttatgagtcagatcattcagaatatgtctagttccagagtttgaagaccatagtgctcctgtctctccacccattcacctttttcttattttcgtatttagatttttaagtattaaagtcaagtattaaaaagaataaggaaataaagggcatctccctttgaaggaacattttatgagtcctattccttgggtgagctgtatagggtacatatgtttaaattcatttaattaaactctgttttctcctcagttcaatttctttgctcttgtatacataatgttgttaggtgtccaaagtgaagtgtactagtttgttacaaaaaagcgattcttttgatttctcctgctgtagaaaagaagcagacctacatcgtttgcagatgagctggctgcccgcatcaagggggatgccatgggtcgagtggacgaggagccgacaagtgagccccagccacgttgatggggagtaggggaggagtagtgcagggccctctgctggcttcaccaaaggcggatttctctttttattagtaattactacatatatttattagtaattgctacatataatttaaattgtagcgcttattccttttttggttaatgggctcctttagataactgaacactgtggacccacaagaaaaacgtacatgtacacatgtagataaccctttacatataatttcaggggattaatggaaactccagagaaccatgggcaacagcttaagaattcctggctgaatatttactcctatattttgaacacgtaagaatgtgctatatagcatattctagttataacagggtagaaagataacacaataattctttcaacaaatacaatcctgttatgcacatgagcctggtacgaaagcagaagccttctgccttacaaagagactcttgagtgcccactgtgggcagggccagggagttcagtgctctggtgcagctgagatgaaaggcagatgtcttgctcttagctgtgagttatgaggatgacagacgtggaaagaaccaggatgtgtatactgagggaggacttagtactattaaaactgtgaactgttcttcaagccttaccctcaggagaagcaaaacctcggaagacactcaaagagaagaaggaaaggagaactccttcagacggtgggccttttccctcaattctgttattttaggagcctgttgactaaggaatgttgcttacataattcatgaagtactgctttacatgctgttttccctctgacaaatgggtctgtctccatttacttttctaaagcctctgggctggacgcggtggctcacacatgtaatcccagcgctttgggaggccgaggcgggtggatcatgaggtcaggagtttaagaccagcctggccaacatagtgaaaccccatttctactaaaaatacaaaaaattagcttggcatggtggtgggtgcctgttgtcccagctacttgggaggctgaggcaggagaatcacttgaacccgggaggcagagatggcagtgagccttgatcgcgccactgcattccagcccgggtgatggtgcgagactccatcccaaaaacaaacagaagccttggaaggcatgttttggggtgctgggaggatatgtgggtgtggagtaaaaattcctgtagagatttgatttattagattttacagcaatcatttcttgtcttcctagaattcttagaagtatagaaacttaggaatctcaagcatttgttttcaataaaggatacaccaggccttttcctgcaaacagccatgtcgattacattagacttgtccctgtgtcagtttgcagatccctttgtttattctgcccttccttcccccagattggttggggaatgggtcttgaatgtggcgtctgacccgaatgcttgcttcagagtaaatctagatccagggtgctggcctagagaatgaatgctgtgtgccacagacgtggacagacttgagagtggaggcccagagagtcttttgagggtgtcagtggactgtgccaggggtttagtgtgaaattcatcagactgcctcacactttgttaaatagtgtcagataaactccatgccagtttggagacacagcagatgccaacccgggaatttgagttctggacccatctttaatactccctgcaaaacattgctttctgtttgctagatgaagaggataacttattcgcaccccccaagctgaccgacgaggacttctcgccatttggctctggaggtggcctgttcagtggcggcaaggggctatttgatgatgaggacgaggaggtgagtccatggcacccagcaacactccctgcagctagctgtgtcaggggtccacagggaagatataggctttgcttgtttagtgggggaaaaacagtttctcagttggaagttgcttctattttcatattttgggacattttgaactaagaatcacagagtgagaaatgccgtatccttctatgctttgttaggtgaggagaagatgtgcacgtgttaatgtgaataatttactaggtgattgtttcttgccttatctgttgtcttccacgtttgtttttaattcctggacaggcctaaattattttagggtctgattttgccatagttatcactttgcaactgattttctggcagagtagtaaatatgtagctttaaatcttgtaggttatttttccttaggaatcctcacatgcagctatgctttctcctggttttttgaattctttgtcatataccttatttcaaccagagtgacctcttcacggaagcctcccaggatcggcaagctggagcctctgttaaggagggtaagctggggctgggcagctgcgtctccgtgtgcagagttccaaaactgtctttctcactaggagatggaacaaggttgttcccaagccttgtttctgtgtcaagcaagaagctgttgtttttactgcggtccagttgaaagtaattcatcttcactaattcatgtcttggaaaaaacagtaccatctgtaaacccataccacagtcttgcctctttgttaggagagaactcatagaaagtcaaacaagaaaagtaccctagagcaatgttgaggatggttttcattgaatgaagtttaatttaaagaaacatttttaacattctgtatataagttggagaccagtaattccccaacccagtgtgcattaaaatcatctgtgcaggtttttttgtttttttgttttttgtttttgtatttttagtagagacagggtttcaccatgttggacggttggacaggctggtcttaaactcctatcctcaagtgatcacccgcctagacctggcaaaatgctaggaatacaggcatgagccactgcacctgtccccttggtgcagtttttaaaaaacacaaatataaatatgttttttttttttttctttttttttaacctacaaatgttactcaataggtttgtggtagttcttgggacttgggaattagtgattctaagtgccgagtctcccgggcgcaggcatcagagctgggccttggaggccgctccttgtgcctgctgtgcgggctgctagcctggctctcctctgctttctgctgtccatgttttggcatcagtgacttgcttggtttccccctttgctcttatgtctttatttttttactgatgactcacatgtttttgcggttctttttcacccgttcattctcatccaactggaatgggtagaggtggaactgtttgggggagccccggtcatgctgtccctgcctctgctgtgctcacctcctcccttggtgtcccccagctgacccactgctgtggcttgatgacggtcagcatgctcttccatttgagtcacagctcagattgtgttaatcccaaaaaaaaagtcctgacatcggtagagaagaaaatactaaggaattttaaaatggcttgttcaggaaaaagtagtttcaaaaggtctggtactagctgtgtgttacattgcacgtatttcaggaagaaaatagcaaggaaagttatttcccttgtaaaatggttaccccttgctttctcattctagagtcttcatcatccaaacctggaaagaaaatcccagcaggagctgtttctgtatttttaggtaacataacttaggtttgttttctaaaaactacacaaatactgttttttgcatttcaaaattatcatcttctaaagtctggctggagatgaggaagtacctgggagcttcaaagggctttgagcatcttatagaaagagctcatttactgatattagctcttattctcctagagctcagtggccttggacttttttgtgtttgagcgacctggtgattctccgttgtgagatgttctgtagcagtaatggatggaggctattgggccctgttatgcattttgtggattaactgaaatggaaagtttttggtgggtgataatttttttctgtaaattcaaccggcccacactggctcacagctgtggctgtcttgtcccttcactcacaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgtatgtgttcctgcctccgtttctaggacttcagccagaaaaagaatgttgcctaaaaagaacataagctcacctagttctgtatctcttacagtgccagaatcccttctccagcattcctgtcattgagttgttgtgtctgtacttacataggtgtggtgcctgggaggtctgttttatgacccaatcttttctgctctgtaagctaattactatgattattttccttatagagagctgaaatccttttctgtataatttttgcttgcaatttccagttctgacctttggtattgtaaagttttaatcatcctttcttccagccgaccttagtcaattacatgagcagcaggttgtgtgccggccatttatttcccagcttctcatttctctgccaaaaagctcaggtggccttggtctttcctcagatgatgttttcatccccttggccactttggcattctcctctcttttcctcttaaatgtaagtcctatgtcctgaagtcattcccataaatcatttgtttttaaatgtgcagatgaatcttccaggggcttttgtcaaaatgaagattccgattcagtaggtccagggtggggcctgagaatttacatttccagcaagcttcatggtctgtagatcacacttcgaatagcaagacttagatccattgactgctcttccagaaaagaaaggtagatccctagatccctaaggtgcacatgattttcagcaactttaaaaaataaaaaaggatggcataggaatggatggaactagaatgcatttagaagccggctgtctggactcactctcttccagtgttaggtgtagaaagtaaggatggaagccgaagtgtgagggaaaacgatagcctagttaatctagaaagagtgcaaacggatgcagaatgcacacaggtctcagtgaagatgacaatgcacacaggtctcggtgaagatgacagtgaatgaaggtagtagtgctttttgtagctccacagggctcttacttagtggatatctttgagaactgatttagaatccctagtaaattgatgctgctttctttgacaactcctagtctcttcagacattcatgagtcagtgacctcatttcagcaacacatgccctattcggtacagcagtgcttatggtgatgaaaggttggaaaccacccaaatacttatcagtagagtaagctatggcccttctattcagtggactattctgtgacagttaaaaagaaaggggtctacgcttgttgacttgggaagattttgtaggtacattgagtggaaaacacaaatggtaagacattgttcaaattatcttcttatttatagccttatttataaataactagtgttaattcattagtacatcctttgggggaattagaagcatgtatgctgaactgttcccaatgttcatcttgtttgagtagactggtggaattatgaggggatttcattatttgcttttatctgcttttgtacagtttgattttttttaaagcaggagccaagccttcatttctcagattccttagatgattgacttggtggccctcttaaatgatctttcttcctctagatctctcttcaccttgtaagccagtccaagctactctaagcacaggaaatggctgcttggataagcatgtcagccacgtggataaactatctgttctgtctttcaactgaactgctactatgcactttgaaaaattccaagggaagagtatagttccacttactatttctttataactaatcaagaaacaacataactttttatgtttattctttgggagggaagaattttttaatctgtgaattttgtgataggatgtttgacgttagtgtcattttatgccttggtattttttacaggcaaagtccaatccactgccgatatctttggtgacgaagaaggagatctgttcaaagaaaaagccgtagcatcgccagaagccactgtgagtcagacagatgaaaataaagcaagagcagaaaaaaaggtgagcaggagggaagacttaacgcaggagcattgatctgcagcattttaataattcatccggaacccagagggaagtactgttccctttcacgttcatattgaagaacttcaaacagaaagtggaaagaacattgcagtgaacacccaaataactgccacccagattgatcagttcttagggttttggcaaacactttatggatgtaaaccttgttacatatctatttttttcctgaactatttgcatgtaagttgtttgaactgtttgctgcatggaactgtttccatgtagtcattgtgacattctacccctaaatatttcattaagcctctcttgaaaagacttccatataagcacaatgccattatcaacagctgtgagactaacagtaattctatagtagaatctaatatctagtctgtattagaattgctccagttgccccagaatgtctttgcaaaatcaccccaacaaatagaatacagatttaaaattatctcgcatatagttcatactgcaatttcctctcttgtccccaaaatgccatttacggcagtgatccccaacctttttggcattagggatataaggagagtgcaacctgcaatctagatccctcgcatgcacagttcacaatagcgtttgccttcctatgagaatctgatgctgccactgatctgacaggaggaggagcttaggcagtaatgcttgctgctcacctcacctcctgctgtgcggcccggcttctaacaggccatggactggtctgcagcccagggttggggacccctgctttatagtatttttttatgttttgattttttttttgttctaagaaactcaggattcggacagtgtgtctgcattgcatttggttgtcatgtctctttggtctccttaatctagagcaacacctcccacatctttttttttttaatatccagccacttgtcttgtagaatgtgtctcgtgaatttgcttgattattttcctatgaatagattcagggtgagaagttttggcaagaatacaagcaggcagggttgtgcacttccagttggatcacctcccaagacacatcaggtccactgtctgcctcattcagacacgtttgtcacttggttgttagggtgcccaccacactgcttcattggaaaggtaccctgttctcttttgccattgctcagttgatctctaaagtgatagttgaacacagtgtgaatacctgttctctcccagccttttactcagtgttttgaaaatccactgatgatcttttcttgactcagttaatctgttagcgggcacaaaccactatttttttaattctatatttcttattagttggcattcttctgaataaagttctttctctccccctccttccccgatttttagtattgctttgggatcatgtattcattcttcagtgtagatgataatccattaccatcattcttcttctttttttttttttttttgtgagacagggtcttgctctgttgcccaggctggagtgtagtggtacaatcacagctcactgcagcctcaacctcctgggttcaagcgattctccagcctcagcctaccaagtagctgggactatatgcgtgcgccaccatgcccggctaattttttgtggagacgggttttgcccatgttggccaaaccatcattctttttgatgctcagattgacctgcatttggccagtgtgtgtgtccccagcagtctttaagcccttctgactgcttgtcctttcactgctgtcctgtacagctggtccctcctctttctacagttttgtctctttgtgtcatgtcctggctgtgaagccctgactttctcctgccgaccacctaaggcccagcattcagaacctgtcaggcccgtcaggcagcctgtctttccatgctgtctctcattgcatatgtcccatctgtgcacccattgacccagactgtgtgtcctgctccctgatacaccagatgtgtcctctgtttgtcttgctgttctcttaacagccccctcagcttgctgcctatcacagcagagactccgtgcgttttctcgattgattgagtaaaccctcttttctgggtatcttacgtgttaatgcttaatttttctttttctttttttcttccccaccccccccccacccccgacaaaggttaccttatcttacagcaaaaatctcaagccctcatcagaaacaaagactcaaaaaggcttattttcagatgaggaggactctgaggtatggaattcttttgcttagttgtgggtattagtctatggatatgacatagaaactatttttgaatcaggtttttctcaatagagttataagactttttgttaagtactccagttctttaaaaattatctctagaggcaaggagtggtggttcatgcctgtaatcccagcactttggtaggccaaggcaggcggatacctgaggtcaggagttggagaccaggctggccaacatgatgaaaccctgtctctattaaaaagacaaaaattagccgggtatggtggtgcgagcctgtaatcccagttactcagaaggctgagataggagattcacttgaacccgggaggcagaagttgcaatgaaccgagatcacaccattgcactccagtctaggcgacagagcgagacttcatctcaaaataaataaatgaataaaaaataatctcttgagagcacaggggctttagaaagcaatatgtttacaatacttttcactttgggttggactgtatttacatttcctgggatgaaaatcctctctctttaggatgctcagattttaaactgttcatgggctcatgatgtgatgaggagcttgcaccagagtggaggtcaccatgctacttcctttattcacattctcactaactagaccgtggcttaatgctgtagcagatgggttctggcatagccatctgtcttgtcgagactgagaccactaacagcctctgggaccctggttcataggttgctttggtccctccaggcaccttagaaccacctctcagaatttcactgcttttcctgagtctctcaggcctaggtcgtcttagatccaattttaagttggccttttaggagatcggagacctgtatgagaaatgtaatgggaaataataagccccttttacagaaaaacatgtggacatggcagaaacttacatgtatttcaagaaactgtgggctctaggttaggctgtcatggttgggctttgcactcacagcaaggatgaacatggaaccctttggaagtatagtgattgcccttgacgtaaagaatacctttgaggctattatttcattgaaggcgagtgtacaaaacatggcaattaaccaaagtccagtcaagtcacaaccctgacccctgagaaacagcatgatggggcctccaccgtcttatgctcatggatcccctgtgtcacccacacctgcacctcggggtctttgcaccggcccctgccactctgaggaatgctgttcccagaatccagctttcttcctcactcttcgatttctctgtgaggcctcgctgatgaaatacacacaacaggaagcctgctagcacataccacgctgtgctcctggtcctctttcctatttcactgtttaccacagcacgtgttgccagggacagtgtatatttgcttattcattgtctctacttcccactaaagtacgtgccatgagggcaggactttgtattccctatttgtatccctaacaccccgtccttaatacctgtgcttggcatgttgtaagccatccagtaattgttgattagacaagaaaaccaaatgtgagcaatttcagtgacttacgagatgttctggttatttgttgctatgaaacaagtaactcaaaaacctagtggttcataacacccatagttttgttgtctcacagttcgagaggttgactgggcttagctaggccgttgtcactgagggtctcttgtgtctgaaggtggctgggctgagggtcagctcactcatatgtctggtacctgggcactggggcccctgggacatctctcactagccctgtgtggctcccagcatgtagtcagggaagccggtcctcttacatactggctcagggctgtaggggagagtcctcagagagagcccgatggaggccatgtcgccttctgtgttccagccttggaagtcaacggtggtccttttccttcatttgttggtcaagatggtcacaatggcccatccaggtttatggggagaggccataggctccccttcttgatggtgggagtgtaaatgtactctcagacttgtgtgaaaaccctaccaaaggctttgccccatgtgtgtcatcatagagtgaatgtttttattggatattgttcagattctgaggcaaggagaagtaaaactaaggcagtctaagtaagagttaaagctttggacccaaaggaatgcgtcctgactcctttctctatatctgaagtgtgaggctgaagcttgccctgtgaagtcattttgggggaacatatttgaggtaacggaagtgtcttttcttgcagtaccaagaaaggtatcagttaagggtccgaaactgtgatgttgacatttgtttttgttctttgctttggtttactttcattttcttagaacagcagaaccctttctcttgccattgtgtaacatgcaggaggggcacgggatgcctggaatcccccacgtggcctcttctatctaaataaacccatgggactccggggagcacaggggaaaaacactgtgtggaggagatctcacttagtgaactcattaggtctatatttaggagtagacagcgaccccataattaaaaaaaaaaaaaaactgtccaaagaggtcttagaaatatcttcttgtcctatttaattgttcggctcttgtgtattgaagtttatcttcccaagggaatagatgtcccattttatgtttctacttcatgtaggtcaacttgcaggtctttctttgcaggataagctgatgttttataacattttgaaaatttcttgatttttatattttttagctattttgagatgaaattatactctttttgcctaggctggagtgcaatggtgggatcttggctcactgcaacctctgccttccaggttcaagcaattctcctgccacagcctcctgagtagctgagataacaggcacccaccaccacacctggctaatctggtatttttacaaaattaatataggctggtcttgaactcctgacctcaggtgatctgcctgccccagcctcccaaaatgctgggattatagacatgagccacagcaccgagctgaaagtttctttagaatctatcaggtcttatcctggtttgcaacgtcatatacctatagttaagctaagtagactagcaaacatttaaaaataaagtttaatttgtatttatttaaaagaaataagtcggccgggtgtggtggctcaagcctgtaatcccagcacttggggaagccgaggcgggcggatcacaaggtcaggagatcgagaccatcctggctaacatggtgaaaccccgtctctactaaaaatacaaaaaaattagccgggcgtggtggcaggcgcctgtagtctcagctactcaggaggcagaggcaggagaatggtgtgaatccgggaggcggagctttcagtgagccgagattgcaccactgcactgcagcctgggcaacagagcgagactctgcctcaaaaaaaagaaaaagaagtaagtcataatcttaggagaggagggtgttactaaataaaatagttgtagctccattaatttgggaatctagcccctgtttctttattgaccctgtctaatctctgattctttagacagtaatgggaagccatgcttatatatttatttttttagcatggtgtaggaaattgattcaaaaacttattcctgccttctgtcattcaggtgggaatacagaagcccctgggctctgcgagcccaccagatcctgtagctctcctcctccttagcgccactgcacacaccctgcacagaccctgaggcctatccctttaaggactctgtctgagccaccttccctctcaggaaagaagcctagacacatggcagctgtcatgtctgagtcacttgtgttttatactgacctgatattttaaaaactgatattcctgttaaccagcaactttaatttcaatccaacaggatttgttttcttctcaaagtgcgagtaacttaaaaggtgcatctctgctgcctggcaagctccccacgtcggtttccctgtttgatgatgaagatgaagaggtaaacattgttattgtaacactagataatttagattaggagaaaacggttgttgatgtaactttctacccagaggctcatatactagcaaaaggtggtagggaagcagtcaggctacctgaagtttatataacaaaaatatttctgtttttatttcagtgacttcttccttatattttcctagctgtgcaatggagaagacattagattcttgacgcagttctttttttttttttttccgagttggagactttctctgtcacccaggctggagtgcagtgatgcgatcttggctcactgtaaccgggttcaggtgattctcctgcctcgacctcccaagtagctgggactacaggtacgcaccaccactcccggctaatttttgtattgttagtagagacagggtttcaccatgttggccaggctagtttcgaactcctgatctcaggtgatccgcctgcctcggcctccctaagtgctaggattacaggtgtgagccaccgtgcctggcttcttgacacagttcttatggagtgaaatctacaggttttatttttagaaatctgcctttgagaaatacaattgaccctttaacagtgtggaggttattttgacttccacattgcagtgaaaaatccatatataacttcttacttcccaaaaacttatctactgatagcttactgttaaccagaagcctcatggataacataaacaggtgattaacatataaatagtataatatctatttatatatttttgtattcctgacatatccagcttttccttattttttttatgatatttctaggccacatggtttgtctgcaagatttttcaaattgttgcaaatgtccaaaaaaattttcaacatattactgagaaaacatttgtgtagaagtggacctgtgcagctcaaacctgtgtcattcagggtgagctgtactttagtctagaggatggatcaacatatacccaatgacctacaagaatgttttggatcaagtggagatacaaaggaggaggcagccatgtcctgaccattgtctttctttcccgtcctggctggagagagcacagtggggaagagaaataagagagaagacaacccaaaccttaactctcatgcagtactgggcggtggtgagctcaaaggctttgccatcagacccctgggttcatatcccagctccaccacttgcaaaccaggaacctggggcaagtaacttaaccttccttaagctcatgtggcttaacagtgagtagggtcactgtggcagctgtaactactagtgtgaagctcttgcagagtgccggcacataataagtgcatagtgaatgtgagctctgtcattagcatccccaatggacaccagctcattattctcctggcctgtcctacattaccgcactctccttaaaggagacttcatccaggaagacactcccttcatccatcttcacattccagggctgttcacctgagtttgtccatcctaactcagactcaggccctctgatgcttttgttccccttatctgaataaaagcaccttaataaatataacttttggggagtgcttgaccacagaagaatttacaaatgccattaaacttagtacaccagcaattttatttagtaagctatttctccactttgtataatctctttgaaactaatgagaaacacaagtcatgccttccctccatcccaggtgtatgtctttctgacctgtaaaggagtggagacagacccccagttctctcctttcagccattgttctggtttctcattcgtggagacaacagtgtgagtttctggctgctgcgggggctcccgtgcccatcgcaggctgtaaccacctgaaatgagcagagaggcacttgcccacagggtgactggatggggctcagtttctccttgtacttcatgatctcatttgcatgttgttctcctgcttatatgcagctgttctgccttcgagttctatggtaatctctttcccttctatgggtgcagtgagaaaaggctgtagtttgggatttactagcattttgcggtttttccccgccagagttgttatttgtatacctgactggagacttacttccttaaagtttgatataggaggacatcctatgttttctgattataaagttgtcttacctttctgccatttgcttttctaggataatctttttgggggtacagctgctaagaagcagacattgtctctacaagctcagagagaagagaaagcaaaagcctccgagctctccaaaaagaaagcatctgccctgttgttcagcagtgatgaggaggtgagctgaggtttctgctaaaaaagaggggattatttcatgggatttaagagttaaagccatcccaagtctttttctacctgttttatatctcgtgatgttcagtcaccaaaggcgatgttcacaagattgtcttttctgaaggaagacatttaatgtaatatattaatttaaagatgaatctcttcaaaatggttaggaataagtatgactcccacacaatagtgtatgctccttcaaatgagttaggccggctaggggggaaatgatttctcagccatcgctagttcatggtcgagtcccttagaacaaatgacagattaaccagagaaaagtgtgcaagtttacgtaagataagttttaccagacacaggagccttcagaaagaaaaactcaagagaaacaggaaatcctgtgtcaattttatgcagtctgatgaagaagcggacagttttgggggagcacgattagatgaaaggggtgtgacctgatgggaataagctggggggagctcagcaaggcctgtgtggtcagatcattctctgcatctttacaaataaggaggctcctttcctctgggaatagggaggactggaatgaaggttttatgacctactccagagagggttagaggattcttctatgtcctgcttcagaggagaagggccagggaaaggtcagagagacctttctgcttctgttttctcaaatgccaaggtgtcatattttgaggtagcatgtcccgtataccccaatggccatatatactagtatcttgttaaatgactactgtgtttcattaatttagaactatagttaggaggagttacctattgaggttaaactcctttttgagggagtcttaacaatatttctgtttgtgatctggatagatactaccaaatcagttagtttagttgctaactcaatcagatttagtagcagggaatcagatttagctgtgcagaaaaagactttaaatatgatgatataaaaaatcctgagtattaaacatcttcctgtgttataataattcctcttttttttaacattgtaggcaagttagtagggggtgaagtggatatataagtcatagatatgttcatgtccttactgaaagcaatttaaaaattctgaagcagattgcaaaaaaaaatgtattaaaagcttatgcggccgggcgtggtagctcacgtctgtaatcccagcactttgagagtctgaggcaggcagatcacttgaggttgggagttcgagaccagcctaaccaacatggagaaaccttgtctctattaaaaatacaaaaaaattagcaggttgtggtggcgcatgcctgtaatcccaactactcaggaggctgaggcaggagaatcacttgaacccaggagatggaggttgtcgtgaaccgagatcacgccattgcactccagcctgggcaacgagcgaaactccgtctcaaaaaaaagcttatgcaacacacatgtgaacaagacacaatgaaaaactgctagtaatccttttactacaaaagtctgagtctggcctttagaaagcgtttaaggaattcccacccagctgtgctcatgccttcacatcaaggaactcccaagcatatataatttgtgttttctactcaaatgtatgaatttatgatagattatccagtttttttcttttaaacattgtcagtgattgttccccctgtagcaacagccagacatcagtgtagttgctcctactagagtattatagtggttcagggaaaataaaaacattacctaaagcttggagcaaaaagacatgcagaagaaagacagccaaggttctagaacaggggcgtccagtcttttggcttccctggcccacactggaagaagaagaattgtcttgggtcacacataaagtgcgctaatactaacaatagctgacgaactaaaaaaataaaaaggttcgtgcataaatcccataatgttttaagaaagtttacagatttgtggtgggccgcattcaaagccatactgggctgtgtgtggcccatgggccacaggttggacaagcttgtcctagaacaaaggctgtcaacttcggctgctcattgggatccatggggaacttaaaagagtgctgacaggccgggcacagtggctcacgcctgtaatcccagcactctgggaggccaaggaggtgggcagatcacctgagattaggagtttgagaccagcctggccaacatggcgaaactctgtctctactaaaaaatacaaaaattatctgggtgttgtggtgcttgcctgtaatcccagctactcaggaggctgaggcaagagaatcacttgaacccgggaggcagaggttgcagtgagccgagaccgcgccactgcactccagcccgggccacagagcaagactctgtctcgaaaaaggaaaaaaaaaaaaaaaaaaaaagaaagagaagacctaacgagtgctgacagtggatcccagctccagagattctgaattaatctggttggggtacagcctcgtcattggagttttgtgatactctctagtggatttcagcgtttagtcactgctaaacattgaggagcacttctcaaaccttcatgtttaggaaatcacccaggcaccctgtgaaatgcaggttctgattcagaaaataggggcggggcctgaaattctgcataatctgctgctggcttgtggactccagtttggtttgcaagactctagactccagagatagagcacttatgcaagtgcttgggagttctttgatttgaaggggtgtgagcatagttgagtagaattcccttaaatgctttctaaaggccacattcagacttgtggtaaaaggattactagcagtttttcattgtgtcttgttcacatgtgtgttgcgtgagtttttacactttttttttcaatctgctttaggatttttaaaattaaaatattcttctctggagttggaagttcttgagttcttggtatttttacatttggcttccttcttatagcctctgtaattaatgttgattccctgaaatagacaagtcgcttgtaatacagtgcagaaccacattgggaagagacatcgtggcaggtgttggaggaggaaatcatgagaagctctgtgaggtcagagagcccagctgtctagatttgagttcaaagaaaagtcttaagcatgagctttcttcaagactgatgcactaagtttaatacttagtttaaatacaacttagtttaacaaatataagtttgattttactccccatgttttataatctaaattgccattggagttttttttcttttttttgagacagagtctcgctctgtcccccaggctggagtgcagtggcacgatctccgttcactgcaagctctgcctcctgggttcactccattctcctgcctcagcctcccaagtagctgggactacaggctcccgccaccacgcccggctaattttcttgtatttttagtagagatggggtttcaccgtgttagcaaggatggtcttgatctgctgatctcgtgattcacccgcctcggcctcccaaagtgctgggattataggtatgagccactgcgcctggcctggagttttaatatatattttatgttttaaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacaggtgagatagtcattggaaggagtccctcactccattaccgtggtaacaagaaaaggaatctgatgcacaatctagttcatcgggtgattgctaatcatggatcacatagtgattgtgccagtgagaatgtctttgcttttcaatggcaccatcttttccctcagtacccggaaatgtttgtctttgtggatccttatctgatttcttccccaatcattattttttaaccatattctttttctttgtttgtcagggatttgagtatcttttgtttgtgatttttctctgggctactctaaagtatgtcaggtttggtcaggattacttaaaagttactttaggccaggcacgttggctcacgcctgtaatcccagcactttgggaggccgaggtgggcagatcacgatgtcaggagttcaagaccagcctggccaatatggtgaaaccctgtctctactaaaaaaatataaaaattagccgggtgtggtggcacgcgcctgtagtcccagctacttgggaggctgaggcagaagaatggcttgaactcgggaggtggaggttgcagtgagctgagatggcaccactgcactccagcctgggcaacggagcaagactccatctcaaaaaaaaaaaaaaaaaagttatttgaatagaaatctgctcagcatttaacacatcctgttaggaggaagttccctgtagagctgtgcagtatcactccaggggctgataacccatagccaacctaggtgcctctccccattaatgctggaactgaagctgctaggatattcagagtgagcgtgggctgtggttggtataacatgctgccagattagcttatgggttcagaattacttccctgcaaatactttttttccttttgaaagcctgacatgattactttgaaattcacctgaatgttattagcagaaagaagtaactgattggacatgtaaatcctatgctttggtgtggttaagcgtcatttgatagattcagaagtacctcaggtttctgtctccaaatactcgaatcttgtcaagcatcaccatttctgcattaggcctctgtaacttgacactcggatgcatctttggtctctgatttagaatataggctctggaaagttgatattaaattctgattctgccagttcctgtctgaataaccttgggcaagttacctaacttccctgtgcctcaatttcctcatttgttaaacaaaaataaaaacagcatttctctcatcggtttgttgggatgatgaggtggaatctaaatgtgaaacgctgagcacaagagctggcacattctgagccctcaggtattgccagttagcatcgtgactgcagggaaatagtacattcctttatttttgttgctctctcctgggacattcttcttcctgtgttgcctggccaccttctttcaaaactaagtgtaagtttcttaagaagccttcccggctgggcgcagtggctcacgcctgtaatcccagcacttggggaggccgaggcaggcagatcacgaggtcaggagttgaagaacagcctgaccaacatggtgaaaccccgtctctactaaaaatacaaaaatgagctgggcgtcgtgtcacgcacctgtaatcccagctactcgggaggctgaggcaggagaattgcttgaacctgggaggcagaggttacagtgagccaagatctcaccactgcactccagcctgggcaacagagagagactccatctcaaaaaaaaaaaaaaaaaaaaaggcctttcctaactttaaacagacaagaaagagaagaaatagggagtagagggcagacatggctccaccttcataccccaacaccctcagctgagcattttctgcactgtatccaggttagcttattcccatgagtgtccactacccccaccccacacaaggtcataaatctggcagtctgaaccccatcttgtttgtgggtcctggttccagccacacaccatacctggctttcaggaatgctttctctgctccagatacatcctacctcctattgttcccgaagttgtctgtcaagttttgtgtatggaaagtaattcataccttcatcagatctcaaaagaagctttacacacacaagaagaagttgaggtgaggatgtggaggaattggaaccctcatacactgctggtgggaacgtaaaatggtgtagtcactttggaaagtagtttggcatttcctcaaaatgttaaacatagagtcaccatatgacataatagtttcattcctatgtatatacataagagaaatgaaattagttgttcatataaaaacttgtacatgagtgtttattgcagccttagtcataacagccgaaagtgtaaacaacccaaatgtccatcaactgatgactggataaacaaaatgtataaccatacgatagactgttcttcagcaataaaaaagaataaagtagtgatgcatcctagaacatgaatgaacctagaaaattttatgttacttgaaagaagctggtcacagaaaaccacatattgtattgttccatttatatgaaatgtatagataaaccacagagacagaaagtagattagtggttgccagggcctgtggggcagggggaatggagagtgatggctcataggcatggcggttctttttggggtcatgataatgttgtgcacttaggttgtagtgatattgcacaactcgatgagtatattaaagaaaacattgaagtatgcactttaaaagagtgaatctggattaagaaaaccattgaagtgtacgcactttaaaagagtgaatctggccaggtgcaacggctcatgcctgtaatcctaactgattgggaggccaagtggaaggatctcttgaggccaggtgtttgagaccagcctgagcaacatagagcgacctcacctctccaaaaaagtaaaaaaattagccaggcatggtgacgtgtgcctgtagtcgtagctacttgagaggctaaggcaggagatcacttgagttcaggaatttgaggctgcagtgggatatgattgtgccattgctctccagcctgggcagtagagtgagaccctgtcttaaaaagtaaaataaatattaaaaatagagtaaatacaaggtgaattttatggaatgtaaattatgtctcgataacgctactaaaaaaaagaaatagaagccaggcacagggtcatttcccagtgctaatcctggccctgtgatctctcttggcaaccgtcttcatgacaattctggaaataggcacgtccgctttgattctttttgtgctataggaagtgggagagaatgttctgcttgggaaggctcaggcatcgtgtgccttgcagcggtaacagctgatgaacctgcactggatagtaacaggaaaggggcaacctgaggcaggagggacagaggctggtgatttgttggagtcagatttcatctatttcaaaggtctttcctgtttgctttcaactgtgtaaggtcaactaatggcttgggtgtttgggtggtaggtggattcctgtaggtgcagtctagaagaaatattgttgttatggtttttgtttttttcatcacacttttccttaatttgaccttttgtttgtttgtgtagccaaaagaagacccagagagtgtcactcctctttgaagacgatgttgatagcggaggctctctgtttggctctcctcccacatctgttcctcctgcaacaaaggtattcttcatctcttagtcccaggaaatgtccttgagtttatgctgcatcagtagtggtacttccccgaatcagctcttcatacctaaccttggaggctgagtcttatggaagaccttatttgcctggtttcagaaagagatcttctgattaatagtattctacagaagaagcacacgtgcaaagccatcattcagtgtcaggtgtaggcacaaggaactgggtctcagaagaggcttgggccccattggcatggaattctgctaacattagactaggccagttaaggcaaaatcattccttttatgagtgtgtgtcgagtactaacactggtcctggtttatattagccagtcagtaaaaaggaaggaaattctcacatgtgctacaaaatgcatgaaccttgaggccgttatactccatcagtggagaaatggtcacacaggtcctagtacagttagactgtggaatactatacagtggtaaaaaaaaacccagggtggagcttattgggatgaaaaacatactgcaggccaaaaaaaaaaaaaaaaaaaaaaagcgtaaacacgtaaacatggtgtaatttaaactttacaaaacaagaaatacacatgaatgcctggaaaccggcctgaaagcatcgatagcacattgttaccagtgattatgtccagggaaaggtatggaatggggaacttcatactctcaatgcctttttaaagcctttttaaggaaggcatttgtgcattactgtggaattagaaataaactccaaacaaaaaatatctaggagatatggaagaagacccttcctgttaaatggagttgctcagcttataccagaagctctcagccctgggccagcatgctgcccaccctgggccccaggctccctgctgctgcttctacggggctcctgagcctttccttgggtgctctgtacttacatctccccctttaaggacatccagtggttgtacaattaaaggagtcaggagatctgattggtttttctttgtaaattataaataaactactctggaggataactgagcaataaattaatgaattttggagcctctggagctgtaaaacttctttcaacctatggtaattatgattgttaaataaaacaaaaggtcaagacacacaacttaagtagctgaatagcctacacgtttttgattatttgtgaaatataatcatctttagacaatagtaaataaaagatatttcttgtttacagatatttcagtgtaagttaattgtgacttggttgtaagcctatgttgaccaaaaggttaaaccacaggcaggagaacttaaagaaatgtaatgtgagttttgttttgagccaagcttgagaactactagcccagtaaagagactccacacaaactgagaatgcgtcccagagtgggccacacgagacacagcatttatacatttctgttatatagaaaatgggaaaagggggcagtgaagcaacggtgactttcttaattcagattggtgctcaatgacattgaatataagataaagtaaatatgtggttaatgtattttcctcattagccttttaccctaatgagtacataggggtcgcagttgcagggtcaggagagggatggttgattttgtgctgcctttgtgcttcatccaataggcaggttgtaatcggtgcctgtcagtgtgatatttgacagactctggccttgcaggtgaggttcagctttcgttcataggcccggtttctattacccatatggccaagatgcagccattttagacaatttttttttcttcagactttccttattttctgacacctatcaagaaagtaaatttgaccaggcacggtggctcacgcctgtaatcccaacactttgggaggctgaggtgggtggatcacctgaggtcagaagtttaggaccagcctggccaacatggtggaaccccatctctattaaaaatacaaaaattagccaggcatggtggtgcacgcctgtgatcccagctactagggaggctggggcaggagaatcgcttgaacctgagagatggattttgcagtgagctgaggttgtgccagtgcactccagcctgggcaacagagtgagactccatctcaaaaaaaaaaaaaagaaagaaaaaaacaggaagtaaacttcatgacaaggatgagcttgtcttcaagaagattaaaactggtactttgggtagcattttctgtggtttaaggaccttagttatatatgaaggaagaatatgatttgccatacttaagtctctttttgtctcccctatcaactatttgcattgaattttttttttttttttttttgagacggagtcttgctctttcgtccaggctggagtgcagtggcgcatctcggctcactgcaagctccgcctcccgggttcacgccattctgcctcagcctccctagtagctgggactacaggcacccaccaccatgcccgactaattttttgtatttctttagtagagacggggtttcactttgttagccaggatggtctcgatctcctgatctcatgatccgcccaccttggcctctcaaagtgcttggattacaggtgtgagccaccgtgcccggcctgcactgaatttttatgtagttttcagtgagtccaggatgttccacaaaagccttttcctttgatcacttcagtgttgccttatctcttctgaaattctttatgccttccagtgttcttttatgtcaagttcaatggttttgcactttacttatctcttcctaactaaaaatccccttgctctcttctttcttcattcatcacattttaaaatcatgattagcaatgtccttccttagtttcccaaatctgccttcctaacttgatttaggcattgcctcaaagcacacttcctcgtgtcatatggtatgatttgtatctgtactatactataatagagctttagttttttctcaagcacttgttgataagtcacttgctgcaaaaatgccatgaattccaggaaagtcacaaacctcagtttcctagtccccaaatccctgcctccctgataaggaagagatgagaaatgggctgaagtgcttgcagacttgtattgaacactgagttggtataaaacactgggactgtccatgaaaatatagtgtatagtcctttcagatgaacagacaaacagatgtgtgctagctgttatataagttaggaagaaagtcaaggaagggtcaagtagagagataaatattatgcttattcaacaaagcaactgacacttaactgaagaggacagagaccgtgggtgacatctgcgtgggggccctgcttgaaggatggggaggatttgcacctacagacatcgagggcagcgtggcatggaagtttgaaagtttgcagcgaccttaaggaacagcagggaaaggaggagatgcatatgagtagagggatagaatggggtatctgctgagtgtcatttgcttcatgcaaggagtgctggtttgggttgggagaggacctgatccagcaggtgttttgttttagcaagacaacgctggataatgtcttctagttgaaatataagaggagtgaggcagagagagagactcatgatcgtctggtggcagagataaggatctgagggagggaggcatgggggttgacagacacaagtagacagatacaggtgatatggtggcgtgaagtgtcctgtccacaagtcccgggtggtggtgtttgttgcttctcccttttggtgctaccttcactatcctgtcctctcttccttgatcacatttagctgaagccctaagaggatggtttgggcttgttctgtatatggccatgctggtcagacacacttttttattgttgtggatgtcatgtactcttcttttggtagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggtggactttttttcttgtatacttgaatgcatttgtctctcgtatgttgtttcaaacacacccaaccccttaagttttttgaccacagaaaataaatggcccatttgtagacagatttgaaaacatagacaagcaggctgtgtccccacagtgcaggaagcctctgcagggcctttcctcccggcccttctccaagacatgtgcgcactgtggtgtgcctgctcctgtctctgtggttactgtcacgtcatggcatctttgctttctaacttgttctcttctgtgcagtgttcctgttacccttggtcctcctttggtccccaagtgcacttgaatttaaatgtcagttttaaggagattttagtttagcatccttttacttttagatgatattggcaaggattacagagtagagtgaaatttctactctttctaaaacactagctttcaagtcctggacggtctgccgtctcttgcaggaggcctgtgggtagttctgctggccacacctgggcatccagctttgtggttgccttcagtctctatatgcctcttttctttctctaacttttcttatacgctgtgtgtccagctgcttaggtctaagatctcccagggcctgtgtgaagagcgttgcatttgcatttgctgctgaggctccttggagctacagtgatacaagcatttcatttgtacctgtgttcctgtgtgaaattctcttcctagtggctgtgtgtggaccccagtcctatcccagtcctggtccacacttgactctgactggttgctgtactgccctctccctgagtgtaagccccttgcggactaggcccagtttgttttgctcaccatcatatctgtagtactggcatattaccttgcacacagtaggcactatgttataaactttgtatttctttaaagaagcatttttttaatagtttgagtactctgaaatcgggatgtacctcataatcaatggtatcttacctgaaatgtgccatttgttgaatgaataaatactgcattttagaattatttcagagattcttcttcaattgcctatacagtgtaagccttttacaatttgagggtctgattttcctgattagatttcccccttggggcttatgtattagttaaatgctacgaattcatggtccactcccaatgattggcacttgtattggttatctttgacacttagaagttcttcctagttcatgagcaaccagtgtgcatcaggattatagccgtcctatcacttgataggagagagggacccatggtcttaatgcttggaaaagttatctttggctacggatgattgtacaagactgtctcttggagcagccaatcaagaattgacctcagtgttttgttacttgggcacagatgtgattcactgtgccctgagtcatgcaaatgtggcagttactgaattaacgagaagcttggcaggctccatgataggatttgtatttccaggtgttacttattttttccccctattattttcattttcaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaaggtaagcaaaaagcagtagtggttcaagtctctggatgagataaaagactctcatctcatggttgtcattctgtcatgtgagtttctgaaggaatcttaaccttcaatgtagtgtgttaatgattctgtgcagtcatttagatatttgggaatcttaatcaggaactcttacctcaagtagcagtgttaggataggggattagaatttcacccccctcttctgggatttacagaccttgttgttccttctagcaaaactttgccccttggccagttgtgggatgtaaacagcaggaaagggaagttaggctggagctgtacagttaagtatttctaacattcagtttaagaaaaagtgttgtagatgaacctttcatactgatcaggtgtcagcaaactatttctataaaggaccatataatgactattttagcttttgcagcctatttgggctctgtcataactgcctagctctgccattggcagcatgaaaacagccctaggaaacatgaagatggatgggcatgactgtgttccagtaagttttattaataaaaataggtgatggtcagctgggcatggtggctcacacctgtaatcccagcactttaggaggccaaggtgggtggatcacaaggtcaagagatcgagaccatcctggccaacataatgaaaccctgtttctactaaaaatacaagaaatagcttggcgtgatgacgcttgcctgtaatcccagctacttgggaggctgaggcaggagaattgcttgaaccaggaagtcagaggttgtagtgagccgagatcgcaccactgcactccagtgtggcaacagaacgagactccatctcaaaaaaaaaaaaaaaaaaatagatgatggtcattctgtgaggttagtatgaccctgatattaaaactagacagcgacatcaccagaaagctagatatcctttatgaatgtagaggccaaaatcctcaacaaaaatactactaaacccaattcagcaaaatataaaaaggattgcacattatgagaagtgagatttacccctggaatgcaaggttggttcaacatctaaaattagttgatataatgcactgtatcaataaaatacagaattaaaaggcgcatgatcatctcaacagatgcagaaaaagcttttaataaaatccaaaccttttcatggtaaagcactcaattaggcataggaggaagcttaatgaacttgataaaggacatctatgaaatccctcagctgacatcatacttaatggtgaaagactgcatgcttttcaaccctaacatcatgaacaacacaacaatgtccactcttggtaattctaatcaaccttgtactggggattctaagcaagccatgtaggtgagaaaatgaaataaaaggcattcagattggaaaggaaaaagtgaaatgaagcaatctgtatttgcagatggcatgatcttttatatagaaagtcttaaggaatctgcaaaaaacatccattggaaataaagtcattaagattgaaggatgtaagatcaatatgtgaaaaccaattgtagttctgtaagctagtaatgaacatttactaacttacaaaagttactactagtaactttcttttttttttttttttgcaatggagtttcactcttgtcccccaggctggattgaaatggcacaatcttggctcactgcaacctttgcctcccgggttcaagcgattctcctgcctcagcctcctgagtagctgggattataggcacccaccaccatgcccagctattttttgtatttttagtagagacagggtttcaccgtgttggccacgctgaccttgaactcttgacctcaggtgatccacctgccttagcctcccgaagtgctgggattacaggcatgagccactgcacccaacctactagtagtaactttcataagcaattaccagcttatgaatgaaattaagaaatcagtttcttttatagtaataccaagaagggtaaaatacttaggagtaaatttagcaaaagaagtacaagacttgtaaactaaaatctacaaaacattgaaagaaattaaagacctaaaattgatggaaagacatcttgtgtttatggaccagaaaccttaatattggtaaggtggcaatacttccttcccaaattgatttattgtaatctctatcaaaattccagcttgctttttgcagaaatggacaagctgatcctaaaatttttatggaactgtaagagaccaagaatagccaacagtcttgaaaaggaagaacaaagttagaagactcacacttcctgatttcaaaacttactttaagacaggatggtattggcataaggttaaaatatatagatcagtgaagtagaattgagagtctagaaataaaccctcacatttacagtcagttgcttaaggtgctaagatatttcagtggggacagaatagtcttcagcagatgtgccaggatgctgattatctacatgcaaagggatgaagttggacccattaataaataaactcagatccaatgtaagatccaaatgtaagaactaaaactgtacaactcctagaatctagagagtatgtgagtaaattatcatgaccttggattaggcaaagccttcttagataagacaccaaaagcacaagtgacaaaaatagctaaattggactttatttaaatgaaaaacattgtgcttcaaagggcaccatctggaaagtcaaacgaccacccacaaaatgggagaaaagatttacagatcatgtatttgataaaggactcagatccagaatatgtaaaagacttataagtcaataataaaaagacaaatagcccagttgaaagaagggataggccaggcgtcgtggctcatgcctgtaatcccagcactttgggagaccaggacgggaggattgctttaggctgggagttcaagaccagcctgggcaacatagcaagatcctgtctctacaaaaaattttaaaaattagccaggcctggttgcgtgctcctatagttctatctccttgggaagttgaggcagaagagtcctttgagcccaggagttcaaggctgtagtgggctgtgatcacaccattgcactcaggctgagtgacagaacgagaccctgtctgaaaaaaaataggtaagacagacatctgaatagagattttactgaagaagatagacaaatggccaaaaaggatatagaaagatgctcagcatcagggaagccaaaaccacagtgacataccacttcatacccgggaagaggaccataataaaaaaaaaaaaaaaaagggaagtaacgagtgttggtaaggatgtggataaatggaaattctcattccttgctgctgcaagtgtggaacagtacaaccactttggagaacagtttgctgttcttcaaattcttataacataaagctaccacacaatccggaattttattcctgggtacatatccaagagaaataaaaacatgttcacacaaaacttgaatatgattgctcccagcagcattattcataatagccaaaagatggaaacaatggctaaacataatatagtatatccatacaatggaatattatttggtaataaaaaaggcaaagtactgatacatgctgccacatggatgaaccttgaaaacattctaaataaaataagccagtcatgaaagaccacatattatgtgattccatttatatgaaatgtccagaataggcatatcaatggagacagaaagtagattagtagttactgggggctgggagtagcagtgagcaggaatggataattactgctaatggtttggggtttcttttgggggtgatgagaatattctaaacttagattgtggtagtggatacacagatctgaatataccaaaaaatcattacattttatacgtaaatgggtagattttatggtatatgaatttgatctcaatggtgatgttatgcaaaccaggttggcaggtcatagattgccaatcctttttatagatctaaccaaagaaatagtctatgtttatttctacaaaaaatgttatatgaatttttttgttataccaatactataagcttatttataaatgagagctgcacacagtgaatatgattaatttgatatattttctcccagtctcttactgtgtatggttttgtaatatttttccacagttgtgaaatatttaacattacttgctgtgttaaactcatttttatatgtaacaataataattattgttaatgtgatttattttgttagaagtaagtttttcattagtttttttggtttttttgttttgttttgttttgttttgagatggagtcctactgtgttgcccaggctggagtgcagtggcatgatctcggcccactgcagcctctgcctcccaggttcaaggattctcccacctcagcctcccaagtagctggaaccacaggcacacgccaccacacccggctgatctttgtatttttagtagaggtggggtttcaccacattggccaggctggtctcgaactcctggcctctggtaatccacccgccttggcctcccaaagtgctgggattacaggcatgagccaccatgcctggcctttttgttaagttttaatctgtggctgtgataaggaaatagggatgaattttagaatgtcaggtctggagcattatattatcaaaccaataatgttgatggtaacttttaaatgttagatatctagtaaacaaaaaagggactcactcggggtctgaaagtagggcagaagtgatggacagccataggaaggcttgtggtcgcacctgtgccaggtctttggcctgcagtgcttacaggtgagggacacatacttgaccactctgtgtagtttgtgcttgagtcagctgctgtctcttcttccctttggaaatgagatgaagagaattcattcagttgtatgttttttaccttcaaaatgtttctcattatggaactaatggattgcttttctaataaaaaatttagatactatacgaagtttatataatatatataacctggaaagattatctctaaagcttgtgcatatatatatatatgtgtgtgtgtgtatatatatatatatatatatatatatatatatatatacacatatatatatatatatatacacacacatatatatatatatgtaaactttgtatttataaatatattttctggtatttttggaagcgccatagcattccattttgtcaatgtttcattcccctactgagtggcttttaggctgtggccagccttttgctaatataatacagctgcaggggacatctttgttgtgtccatctttacatatgtaacttccttgagataagttcttacagctctaatcacacatgaccttccctcctgttcccagggctgcgatcctgatgcccaccccaagagcacaggtgtcttccaggatgaagagctgcttttcagccacaagctccaaaaggacaatgacccagatgttgacctttttgctggcaccaaaaaaaccaaggtcagttccaaatggttccccacagtatgacttgttattgtattgggtgctgtctcaacagctcacctagttctctttgtaaattgttttgcttttggatattgaacttgggtcttgtttattctagctgttagagccaagtgttgggagcctgtttggggatgatgaagatgatgatcttttcagctctgccaagtcccagcctttggtaccagccttttgttctcaatactgggttgtgtgggaaagattctgggaaaggaaactaacgtccagttagatgattaaggaaaatcctaggagagtcgtgctgcttcctgctaaatgaatggcaaataacatgccgaggggagcgtgtgtggaggatgcaatgcttagtttctgttgttcctcatcttatgttccctatactaacattaaaacattaataatccaggctctctgactgtactacacatctgtgtgatgtttaaatggttgattgaaagaccattgcatacactggggtggctaaatattcgtgcctttcaggtgcaaagctttgaatctgagttttagcctttctatgtcattttctcccccagccccagtaggtttttgtaagtactctgttttctttttatcatagagaggactcctgtgacagccacagtcttcagaatgctatttctgaaatgctacctttgagttggttcagccctcatttgagaaagtatttttaagactcagaagccaggattgttttttgcattatgatttttccttaaaacttctaagatatttgatgcctttttggtattttttttcttttgaaggtacaagagaaaaagagagtagtgaaaaaagaccactctgttaactctttcaaaaaccagaaacatcctgaatccattcaaggtagtaaagaaaaaggcatatggaagccggaaacacctcaggttagaaatcctctttaaggattttcagctcttgtttgcatcccagtacagagaaattccattatgcagacccacagttatttagacttgtctgcattaaggaggaaacagcaaccagggctacagctttgtcttcactgcacttcccccgagtcatctcccctctcctcactccacacgccagagtttcatgaatctatactttaatagttagtgttttttgatgccatgccagatttgactctgaagtggagttaaggtaggatgaagaatcttcttcccactaaagaatttatttctccctctggatttccttggaatagaattaaaatagaaataaatataaattacatctgatttcctgcctgctctcagtgttgcctctcccgaggtcattgctgttgggccgtactctgcagcagtcttctcagaacgctgtggagctcctcctgggaacagcccaggactggagagcgagtgacagttccacgtgcaggtgtcccagggtgtctcactgaagccttagtgtcctgagccgtaaacctgaggcacttggacgaacacatcaccactgacccttcctggggctcagatcttttgcttttagagccagtgcattaggctatggttgaatttttgtgtgctccttgaaatttctatttgataaccaacatggtaattttgcctgctggtcagttttaggtgctctgataaactgtgactcttgggaatcttactcatcttgtattccttgactccatatctgatctggcagctttccacttatgtgacagaggaggaggcatacgtgaagtagtgctagtgaaacatcaggccccaggagagatttgaatgcctttcccattaaagagctacagaaagtgacagttttgctccatcacagatttatttacaggcataagaaacacttgtctttctgtttcccaaatggatttttaactggatgtaatcttacacaggactcatcaggtctcgctccatttaaaaccaaagaaccatccactcggatcgggaagatacaagtaattaaaacactggaatcttcattgcctgccctgtggcatctataaacttttttgggtttcctactcttgtcagctgctgccaaacatcttctcatctcttcccccgcctcccctcccctgcacctagttgttgtctcctgtgtgctgcgtctttaacatctattctttgagcccagtggtgggcataggtgtaagacgctctgttttaattctgagactagattgggcgattttcctacgtttctctactcctctcgtattatacattatgtgtaccgaatcttgtcatgtgtcacaataaagataatagactgctgtgttgaagaacaaatacagagtttcatttttcttctttaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaaggtgatgaaaccatctttgcttccttgctctcttcttttaaccagaacatgcatatgcttctttctagtttatcagttgcatacacagcagtctttgactctccttttgaaggaggtgcctcatccttccttcagccgctcccccctccattctccccacccccctcatcctgcacctgcttttccatggcctgcatttggtacatttgcattctgctcagtagccacagtaacgtctcaccactttggctggtgtctgacacctgcaggtttccagcactgccacctgggggtcttctaaccacagagcagatcatgcccctcctgctggcgcttcctcactactccaaggagagcattcgggctcctgggtttggtatgaaacccctttgcaatcggtgccagcccatgtgtgcagcttcctcactagtcacttcacactttccagcctgactccaggcacaccaggtgccactccctgaacacacatggtctgttctgctgctgcccaaggctcctgctgcctcctcaccaggaatgcccctctctgtccacagctgtgcttccacatccccacttctgtcactgtgccctgcactccctgcaccaagttcccacagcagcgacactgtttcatgggatctcctcaatggactgtgaactctttgaagttttcctttcattgtagttgggtttcttgtttctatccagtctcccttctctagaaagctttaactgatctgcaagtaagtgacaggacacagaatgacctaccctgacaaatagattcatttcaaatgtttgcaaacctgtttccttgtgcaaaacaaaacagccttccttttaacgacaattttcattggctttttttttattaagtttaaattggcaactaaaattgtgacattcccctgaagttgacaacacaatcatactttgcccagagtagattgtagcttctcaaaattctacttgattgtatattttggaaactatcataaactgcatcattgctactaagtgattcatgttttgagattatatgaaaagttctgatttctaagccatatttcttatgtggaatatttaacatttgaattcaatgtttattgacttgaagaaaacagcaccttagattacctctctttattgtgtcatgtttctccccgctcctggagcctgaatttagactagccccctaacaaaggttagtaccagaattccccgattctttcttgttttgaaagatacccacgtttctgttgagggtagagtaggggccaagggaggggttgtgagacacagagagccaacatgcctactttccaggtttccagcaacagatgaaactttttgtgtgaaactgaactgaaactgccctgaaaagattaaaaaatggagaactctaaaggattaagaatgacttagtcttggagtactaggagctattaaactccttccttggaaatcattaagaaataacctcttctatgttcttagataatatcttcattgaagtagaccagataaccttacaatattttgagtcactgattctttgccatggtagctttgaacactttattttatcgtcagatcaatgtatgtttttttgccgttgcagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggtaataggacttaacacgtttttgtgtctgttctaagttaaggaaggtatctgattggcttatttgagccatagattatgtctagcttgttgcgtgcataccccatagccacttgcttagtaattataattaggctcttttattaataagtctaacattgattcagaagtggttttttgttttgttgcatgtagaatgtatttcttggctggccatgatcattgatactgatcttggtttctctagtttttacagtttttttatttttatagaatattgttgtaatcagcttcctgggcatgccactcggtgacatggcatacagctccactggtccagcttgggagtttaacctctggttctggggacattggccctggctggagctgacaatgtagtgcatgcaggcaataagactttcagtggcatttgctcagcagatgtttattgagcacctggggactgcaggcacaaggtgaactcagagaagtgctaggctcctcagagctctctgggaagataatcaaatacaaacagggcaatggataattaagatgttttcaaatagtactaagtgtcatgaagaaagtaacctggggcagagtggtgggtagggctgggaggtgctcctttaggcaggactggtagagaaggtgtcactgcagtggcggcatttgagccggggtgagatgcgcgggccaagctgtgcagagatctggggtagtgcatcccaggcagagtgggcagtctcgaggccgttccacacaccctggccaattgcatttccatagcttgttgacgtgtttgagtttaaaaagaaaaattgatttaacattgttttgtatgtatttttggcttaacaaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatgggtaagtttggttttctacatctgacctagagaattcttacctttccatcacttggtatttttcctgctaccttttcttggcccttttctggaaaatgcaccccagcgggttcacttcagtgtaatcctgagttaggctgaagataggtaagagatggactaattattttagtgaagtaactctttcctatgatagtcatcaaagaatttgaaggcacccagagtttgatgtttaagtataatttaactttgatctcagtgcacctcaccaatcatctgtgacacaccctgatgttatgtaaggaggtttgatcagaaatgacctcacgtgctaaagtaggctgaggggactgccttgggtgtgatgtggttggttgagtcagagctccagatggacagggagtgtccatggttctgtgcgagaagagagcaagtctagacctgggtgtaggctctacctcaggcgttgcatttcactgaggtctttggtgtttgggaacaagcttgtcttccttatatggcacaacttctgctttattagtagacaaggcaaatgcccgagaaccctaaatattggacttttgataaatcctgtgggctgagccacatacacatttcctactccccccgtcaatctagacctttagactaactgggagacagctggtgctgcagagccacacactggctctgtgcctccagcaagccgtatgctctgtctcccctgcttcccaccacatggaatgcagaagggaactcattcattattttaaatacaaaaaaagtaatacatgcttattgtaatagattcatgcaattcagaaaatgtaaaaagtgaataacccctagaggtaatagtaacagtttggtatgtatcctttcagacacagtgatattaatatatgtttgtgtacacatcaatatatacccacctttttaaaaagtaagaatatatttccctattctgctctgtcttttagttacttaatgtcttttcatgtcagtacgcagagatctccttccttgttttcagtgctgtgcacgatttctttatatttagccattagcctgttgacggcaatctcgattgtttctgttttctttattacaaataatgctgtggtctttaccatttgtgtacacctaactttatgtatacatgctaaaatcatggttggataaaaccctagcagtaacattactgggtaattaccataattagataagacaagcttttgagtcagtgaaacactaaacgaatgcagtgacggaggcttacagtcttacatcgagatgcctcaaatcagtgcatttattctgaaagaaaacaggtgggtcctatattggatttccctttgcatatttttattgctcttttaaaacccagtatgaaaagaatatctaaataagtccattgtccctgatggtaggggcgtgggctggtttggagatcaagttacccttcccttttttctgtcctgcacacgcacatacatacacttttgtagctgaagaaattgtgctccaagagaaacctgtgtgtgatcataaaatttaatgagtaacaaacacagaaccagaatctaagaggcttgagttctaggttagtgttttagggtactccatgctgttacgagagctgggtctttggtggtttgcttgcatgtgtcttaaaagtacctttctccacccctcttcagcaactgtttttcttttttctttctaaagatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatcacattcatttgtttacttactgtctattgctgctctcaccctacctccaatgtaagagttgagtgattatgacagagactggatggctcacagagcctcagatgttttctatctgcccctttatatacagtttgctgaccattgctctaaggcatccttttccatccttgtcttgtggaagcagcagaatgaacctaggtaatagccgggggaagtgctgaagatggaaatgtcagcctctagagcagcactgccccatagaactccacaggaatgaaaatgttctttatctgtatcgacaaaggcagtagccactagccacctggatggctgaccccattctaatctgtgttttttggtgctctgtcgtcttgctgctgactatgcagcctgtcaccacagcacagtcttgtaggccgcccaggttggtctcagcgatcgtggagctacttacttcttccttgggcactgtaagatcggaaggggaattactcatacccagagtcaaacattttgtacggcttccacaggtcaaccatttgcccaagtctgctgtgagagtgacgtgataacagataagggcacttgctagttggccactcctttcccctattcattttatgcatcttccttctgtccttaggttgagatctccgagtcgctgttgtcaggcagactgctgtcctccagattcaggcctgtgggtctggggagccctggttggtcttggaggagcaagggctgcgcaggtgacttggtggcctcaagtgtataggtacctggatggtgcgaggagatgctggctctgaaatatttcctaatcccgcttgcggatcaactgccgactagcgtttaggttacagacatattagatggttgatgtgattctgtagctcgtatttagaactttagggatgttttcacatatcagtaaatgaagatctatgtcaacattttttttttttttttgagacggagtctcgctctgtcacccaggctggagtgcggtggcgtgatcccggctcactgcaaccaccgcctcctgggttcatgccattctcctgcctcagcctcccgagtagctgggactacaggcgcccaccagcacgcccggctaattttttgtatttttagtagagacaggttttcaccatgttagccaggatggtcttgatctcctgatcttgtgatctgcccgccttggcctcccaaggtgctgggattacaggcgtgagccactgcgcccagcctatgtcaacatttctaatggtagcttcacattctggatatctttatgttggggaaaaagttttaaaggtaactgctcttctgtagcaaagcttttttagagcagaggatggagcaaattctgagttactgaaattacgtattcagtgctattgccttgtttaccttccatttcatctttggagttgtgtttttagaactttttcagaagggatgagataaatgctttgggaatttatttagaaatctttttggtgtcattactcttaagagctagatatattttttaattgtaaaaaattatggaaatacttttttctctacctgctcccatttttttttttttttttaaagacagggtctggttgtgttgcctaggctggggtgcagtggcataatcatagcttgctgcacctttgaactccagggctccagtgatcctcccaccttagcctcctgaatggctgggactacaggtgtgtgccatcatgcccagctaatttttaaaaaaaaatttttgtagagacaagggtctgttgcccaggctggtctcaaccttcttacctcaagtgattctcccaccttggcctcctgaattgctggaattacaggcatgagccacaatggccagcttctttctgttttctttgtttcctcttccccttctgttttcttcctttttttttttttaagctgttctcgcatcattttccatcccatctttaagtcttcattgccacctcattttccaagatcatgagtcccacagtatgctcagctaagcatgaccacacaccatttcaagaagccgttcatggacccagcttttattactggctgggtctttgttctcctgctgcagcttccatttgctcctcagctaccctctaggcatccagtctggcttaaccagatttcatggcctcattttgtcctctgctacagtgatttctactcctgaggagaagcataactatcttctagagggaaacattttagcttttggttatcaaccttggttcttttgggatattggaaattaccccattgactggacccagacttacggtggaagttccagcacaattaatgctgaacggggttatgctttttcttctggcatatagttgaattatccattctcattataggtgaaggacttccaaatctgtttgttatcttctaccctcccccagcctattattttcagggtctcactatggaagaacactgtggtgaaggaaacaatccatattccttaggcagttatagtcactcatgtctttatttctgtcatgtgcattttgcagtcctgacacctgacttctgttgctagagctgcacctgtgtaggtacgagtactgttggcttcggggatacacacgctggcaactctataggacagtcttatttgatatagcataagtatgtttttaagaattcatgttatccaaaattataaaagcagttgtttgaatgagtgaaagaaagggggttaaggttagagagctccatacaaagtcatatataagcaatgcagctttttaatttagcttttatttaagagcaatgaccctttaccactatcaccagcagtattattagcctggtaccttgtattactcttaatacccatcattttgaaatatggtgcaacgacactcaaatgagctgcactacaagaaacaactttcctttctgtaatgccctccctttaggatcactagaagtctgtacaatgcaatgcagattcccgaattaatgatctttcctattagtgtaattaaaaactcatattatagcagattcctgtatgtgcatgtatgttatgagttggataaacgttggtggacttcatttggagtgaatcagaatgggattcctgtgagaagccaacatccctctaaacaaacttttggagcatgatatggcttggatgttttgtcccctccaaatctcatgttgaaatgtgacccccagtgttggaggtgggcctagtgggaggtgtttggatcatgggggtggatcctcatgaatgtcttggtgctgtccttgtggtaatgaatgagttctcactctgagttcacatgagatctggtttaaaagaacctgggggccgggcaccgtggctcacacctgtaatctcagcactgcgggaggccgaggctggtggatcacgaggtcaggagatggagaccatcctggccaacatctagaaaccccatctctactaaaaatacaaaaattagccaggtgtggtggcacgtatctgtagtcccagctactcgggaggctgaggcaagagaattgcttgaacccaggaggcagaggttgcagtgagctgagatcgtgccactgcattccagcctgggcgacaagaggaagactctgtctcaaaacaaacaaacaaacaaaaaacaacctcacacgtccttcctctctctctctcttgttctctcaccatgtaacatgctggctcctctcctctaccatgattgtaaacttcctgaggccctcactggaagcagataacagcattataccccttgtacagtctacagaaccatgagccaaaataaacctcttttgtttataaattgcccagtgtcaggtattcctttatagcaacacaaacagctaacacaggataaccaaatagttattaatgtctaaaacttggataataccttacctatagcacaggtttattctgaggatcaattgaaagacaaaaatatctgttctttccttgaacaaagctttaatgagtaccaatatgtgcaaaacactgtgctaggtggtagagatcagatgtgctcccttcagtttagtaaaaaatgaaattgttagggaccgggtgcggtggctcatgcctgtaatcccagcactttgggaggctgaggcgggtggatcacgaggtcaggagatcgagaccatcctggctaacacagtgaagccctgtctcttaaaaatataaaaaattagccaggcgtggtggcaggtgcctgtagtcccagctattcaggaggctgaggcaggagaatggcatgaacccaggaggcggagcttgcagtgagtcgagatcatgccactgcactccagtctgggcgacagagtgagactctgtctcaaaaaaataataaaaataaaataaaataaagaaattgttatgggtgcaatatatgatgtaggtagtagtgtaaagggggtaggtataaaagctttgtggaatagttgatattggagctgaatgttgaaaggtgattaggtgcttgtcaggtaaccatgtgtgcacaagacagtaagtagagcagagcaggagcaacaatatagaagctgatgtgttctgaagctgcagatgcagatgattagaggatagaagtaccagagatgttgcaagatgaggtgaggtagtagatgggtaaaatggggccggaatatgaggtgcataatcttgggagcatttctaaggagtctgaattttattctatagacagggagaagtcattatagcgccttgaggcaagaaataacatgatcagctctacgttttgaaaagataactgtgctccacattatgtgtcattagggaaatgcaaattaaaacagcagtgacgtactattacatgactgttacaatggctgaaatccaaaacactgacaacaccaaagctggggaagatggggagcaacaggaactctcattcactgctggtgggaatacaaaatggtactttggaagattgtttggcaacttcttacatattcttactgtatgatccagcaattatgctcctcggaatttgcccaagtgagtagaaaacatgttcacacaaaaacctgcatacagatgtgtacggaagcttttttcataattgccaaaacttggaagcaaccaaaatgtccttcagtagatgaatgtataaataatctctgtactatacccagacaacggactgttattcagcaccaaaaagaaatgagctgtatcaacccatgaaaagacatggaagaaccttaagtgtgtgctactaagtgaaagaagccaatctgaaaaggccgtatactataaaatcccgaaatacgttctggaaaaggtaaaactatggagacggtaaaaagtgtagtgtttgccaagatctgaggggagagaggaatgaataggcaaagcacagaggatttgtagcacagtgtatgtattctgtgtggtactgtaatggtgaatacatgtcattatgcattagttcaaatccatcaagagtgaaccctaatgtaaattacaaacttcaatttatgtgtgaaaatgatgtgtcactgtggggttcatcagttgtaataaatgtaccactctggtgcaggttgtgataggagaaggctgtgggagtgaggggcatataggaacattgtaatttctgctcagttctgctgctcaaaaaaagaaatctattcaaaaaggagccttttcatgtttagactaacttagttcatttccctcctttagttccttcattggtgaggtttcattgcaatgcattctcaagtcgaacataaaattattttagagctttgtgtgacttttccccttgcttaaacatcattgcggaataatgtaaaaatatgataccctaatctagttttcataaacttttttcaaagttgaaaaaaaaactagcatcatggacagatgggttgaaagagtgaacggcaagaatcgaggatcaaaactaggccatgaaaattgctcagttgagagctaatgaagccctaaattaagtcctaatcattgtagatggagtgggtgacagatttaaacaatattaagaggctgggcacagtggctcatgcctgtaaccccagcactttgggaggccaaggcgggcagatcacaaggtcaggagttcaagaccagcctggccaatatggtgaaatcccatctgtactaaaaatacaagaagtagccaggcatggtagtgcatgcctgtaatcccagctgctcaggaggctgaggcaggagaatcgcttgaacctgggaggtggaggttgcagtgagcccagatcgtgccactgcactccaacctgggtgacaaagcgagactgcgtttcaaaaacaaacaaaaaacaatattaagaagtcatattgtctagaattggtcatttctaggtgtcatggggttgggggaaaatccaaaatgattgacagatcattttgagtgatggcatgaaaggcatctctttaccaagatggggactacaggaaagcaggaggtttgtgggaaaaattataagttttgagtacattggatttcagaggcctctggaatatcatgcttatggagtggagattactaacaaaaccaccatctttaaaaataactgcttctttaaacatgcttatattgtagtgagttcagtgatatatcctttggtagaaaaaattgtaaaaaaattatgtatggcacatttctctgacgcttgcactttcatagtgttcactttctgttcacctaggtttacttactgatatccttctcccactctgaggctttgcctatcctgaaatacatctaaacatttacccatgtcagaaacacttcccaactcatcctataaggccaatattaccctgataccaaatccagacagacataaagaaaactacagatcatctcttatgattatagacacagagatcctgaggaaatacttccagaccaaatccatcaacatatgtaaaggttacgtactatgtccaaatgggatttatcccagtaatgcaaggttgatttgacacacaaaaattaatgtaatatatgaataaaagaggaaagaaaatcacatgatgatttcaatagacactgaagaaagcatttgacaaaattcacaccccttcatgattaaaaagaaaccccactaaaataggaatagaagggaagctcctcaacctgataatggttatctataaaaaccccacggttaacgttatacctaatggtttccttctacagtcaggaataagacaaggatgtccagtctcaccacttttattcaatcttatactgaaggttctagagcagggcaattaggcaagaaagggaaataagaagggcatggtggctcacgcctgtaatcccagcacttgggaggccgaggtgggtggatcacctgaggtcaggagttcgacaccagcctggccaacttggtgaaaccccgtctctactaaaaatacaaaaatttgcctggcgtggtggcggatgcctgtaatcccagccacttgggaggctgaggcaggagaatcgcttaaacccagcaggtggaggttacagtgagccaagattgcaccattgcactccagcctggacaatggcgcgagactctctcaaaaaaaaagtgggggagggaataaaagggcatatagattagaaagggagaagtaaaactctatttgtaaatgacatgatcttgtatataaagcttttatatagaagatctttgggaagaactaaataactaaatgaactaaataaacagttcagcacagttgcagtgtacaagatcaatatattaaaatcagttgtgtttctatacgctagcaatgagcaatctgaaattaagacagtgattccatttataatagcatttaaaggaataaaatacttaggaataaatttaacaaaagagaacaaaacttgtactctaaaaattgtgaaacattgtggaggtaaattagatataaactgaaaaatagtacgtatttatggattagaagtcttagtattaagattgcaatactctccaaatctacagacttaatacaatccctgtcaaaatcccagctaacatttttgcaaaatgggcatacttaaaattcgtatggcaattcaaggagtccagaatagccaacaatctaaaaagagaagaacaaattggaggactcacacttcctaatttcagaacttactacaaagctgcagtaattaagatagggtggtactggcataggtagatcgctagcataaagagtctggaaataaaccttcacatttacaaaaaatggatttttaacaaggatccaagacaattcaattgggaaagaatgatttttctgacaaatgatactggaacaactgtttatccacatgcaaaagaataaagttagaccctacctctcaccatacacaaaactaaattgaaattggacaatacacctaaatataagagctaaaactatacaattcttagaaaaatatataagtcaatctttactacttgggataggccaagcttttgaagtatgacaaaagaaaaatagccaaattagactttaccaaaatgaaaaacttgtgtgtctcaatagatgccatcaagaaagttaaaagacaacccacgaactgagagaaaatatttgccatttatatatccgttagtgtttttatctagaatatgtaataaaaaaactcatacaactcaataaaaaatccaattaaaaatagacaaaatatgtgaataggcatttctccaaagaatgtatgcaaatggccaataatcacattaaaatgatgctcagtaccattagtttttaaagaaatggaaatcacaaccacaatgagatactacttcacacccactaggatagctttaatcaaaaagacagaaagaagtattggcaagggtgtggagaaattggcaccctcattcattgttgatgggactataaaatgatccataccatttagaaaaatttggtagtgccacaatttgctaaacataagagttaccacataacctagcaaagctacttcagagagaaaggaaaacatatgtttacacaaaaacttgcagttgaatgttcatcttagcattatatgtaacagcccaaaattggaaatgactcaaatgctcatcaactgatggatggataaacaacatgagatatattgctacaggggactattattcagcaataaaaaggaatgaagtactgatatatcctagaacatgatgaactttgaaaacattatgctaagtgaaagaagccagtcacaaaaaaatcatatatgatcctatttatgtgaaatgtccagaatagaccaatttggagatagaaagtagattagtggttgccctagggttgagtgggggactgggggaatttgggagtgttggttacagggtatggggttccttttagaggtaatgaaaattttctaaagcaaatgtggtgattgttgcacaactctgtgtacatcataaaaaccagtgaattttaggctttaaatgagtgacttttatggcatgtgaattatatttcaataaagctttttttcttctttttttgagatggagtcttgctctgtcacccaggttggagtgtagtggcgtgatgttggctcactgcaacctctgccttcttgactcaagcgattctcctgcctcagcctcccgagtagctgggattacaggcatgcattaccatgcccaaataatttttgtatttttttggtagagaccaggttttgccatgttggccaggctagtctctaactcctgacctcaggtgattcgactacttcagcttcccaaagtgctgggattacagatgtgagccacttcacctggccctcaataaagctatttttgaaaaggtttaaccacctcaccagaaagacgtgtatcatttgtcctagtttaagttcaaggcccccatttacaaatttttcactgattaatagtcttttcatgtcactacatagagatctccttccttgttttcagtgatgtgcacctctgggtctttgcactggctcctgccactttttcgaacactgttctcagaatccagcttgtttcctcactcttcgatttctctgtgaggcctccctgatgaaatacacacaacaggaagcctgctaacacataccaccctgtgctcctggtcccctttcctgtttcactgtttaccacggcacgtgttgccagggacaatgtatatttacttattcattgtctctacttcccactaaagtaagtgccacataggcaggacttttcgttccctgtttgtatccctaacaccctgtccttaataccagtgcttggcatgtggtaagccacaggctcttgtggctatacaacatttgctctgttctcaagtggggtgattctgtcgatgtctggagaaactttgggttgctatgccttgaggattaactaggtgctactgacatccagtagctggaggccagggaggcttctgaacactgtagaatacacaagaccaccctcaacacaaagaatgattcagccccaaatgtcaacagtgctgaggctgagaaaacctgtgttagaccagcactatccaatagaaatacaaccaaccggtcgggcccggggtctcacatctgtaatcccagaactttgggatgccgaggagggtggattgcttgagcccaggagtttgagtccagccttggtaacacaacaagacattcaacaagaaattaaaagattagctgggcatggttacacatgcctgtggtcccagctacccaggatgctgaggtggaagaaccaattcagcccaagaggtcaaggctgtggtaagccatgattgcaccactgcattccagcctgggcactgaggccacacttcctataggctgctcccagccagaaccgagcatgccagggtactagtgccacttgttcctgcaggacaagggaatcctctaacagtcaacagtccaccagagactcccaactgatccggccaaacgttcctagagctgtgctgtgtctcggactcctcctgccctaccttccttcctttcccctctcccctctcacacggcagtctgaaggctctccctgatcactcctggcccctctcttaacctgcacaggtgcatccccaataaatctctgctgatttcattctaacttggtgtctgcttctgggaggattcatactaacacaggtttcaaggtcagacagcattcaaatcccacttccatcacagaacctgagccagttcctacccctttctcagcctcagtttcctcagcagtgaaaagaatattgaaacagaaactctttgaaagctcttcctgtcctgatctgttccagaatcgggctcagcagggttcatgcaaggacacaagtgtagctgcctctgaggagcccctcacatgcccattttagccagtttgtttctccctgggctcctacagcacatgtgcccatcacacagggttgcaaacaccagttttcttctctgattccccaaagggtgctggacacctgtagaggggctctgttttggtcacttgtccatgatgctcagagaatgtttacagtgcacagtgaatgccgagcactggaaatgctcagtgaagcaagccaacaccagccccaccagatgtcagcaaggaggagttctgtggctatagtctctttggttccatggaaatgacaccaacaacccacataattgagggccctgtgcaggtgccgggttcccagcaaaagtctttgcatgtattttctgttatatgaatcctcctggcatgctcattgagaggttccattactacatgcccatcttcataaactaaacatgaataaactgaggctcagggaactggagttgatggtcccagcctgcacagctaggaagaatcaaggggtgagttttgggttttattttgcatatttcagcagctttactgaggtataatttacacaccataaaatttactcacaataaatgtacagttagatcagcaaatctatagatttgggcaaccatcagcacaagccagttttagaacatttctattaccctgaaaacatttctcttgcctgtttgcaggcaatcttccattcccacccccagccctaggcaaccaccaatctgctttctgactctacagatgtgcctttttctgcacattccctcttagtgaaatcatatactgtgtggcctttatggttggcttctttcacatagtgtaatgcttctgaggttcatccacgttgtaatgtccattgtggcttcatccctgtctattgacaaataaagttctgtttcatgggtggatcacaaacgtctacatatccattcttcagctggtgcacatttgggttgtttccagtcttgagccattatgaataatgttgttatgaaaatgtgtgtataagtttttgtgtgagaatatgttttcatttctcttgggtagatccctaggattggatttgctgggtcacatgatgagagtaagttatacaagaaactgccaaacttgtctatgtaaattggttgcccaccagcagcatatgagggttccactgctccacacagtagggctgagattggaggcaagtccagcccgaccccagaaccccattacccagctctttggtgatcctttctaacattgggatacccagctaaggaatgaggatcatagctgtgcaggaatgagggctgtctgtgaaaacaagaagtgctcctgcaccagcccagacaaagacccctcacttatctcatttatttcttgtcctccaagtgatgctggagcccctgggtttccccacatgcaatccctcaaatttctgacccctgctatttatcttccattgagccttaggttccggtgagagtaacaaggatagacaagggttcacagcccagggctagggatgccctataccctggtcagtgaccttggaagggctgattcagctggaactcaatattgaagcacctaggatgtgcctgtttacacacagaaaaaagataatgcagaagcatggggtccctgattagctgatctgagctggggtggggcttggcaatcattggatccagtgcttttcctgaaacatgagcattgagtttcctgcccacacaaccctgggcttaattaagtccaagcaacaaacagggtcctcagtatgcttaaaggattgacattggatggaagacaattcaatgtttgagaaatccctgcagaccctctgggagtgtcttgaattctaaggagaccatcttgccctacttccttatttgacagaaatggaaaactgtggctcactgaggtggagtgaaataccccaggtcatccagcaaggtgagggtggagcaaaggcttggtcccatggcatatattcatccatctccttgcccatccgttgtcttccagcagaatgtaagctctgagaagataaggattttcctctccttttctacaactgctgtcttccttgattctagcacagtggctggcacaggttgggtgctcagtaaatatctggtgaatgggccaggcacagtggctcacgcctgtaatcccagcactttgggaggccaaggcaggtggatcacctgaggtcagaagttcgagaccagcctggccaacatggtaaaatcccatgtctactaaaaatacaaaaagtagccaggcatggtggtgggcacctgcaatcccagctacttggaaagcagaggcaggagaatcgcttgaacctgccaggcagagattgcagtgaaccgagattgtaccactgcactccagcctgggagacagagcaagagtctgtctcaaagaaagaaagagagagagagagagaaagaaaaaaaagaaagaaagaagaaaatgaagaagaaagaaatgattctaagttattgtttttaactgctgcagagtattctgtggtaggaacatacaatagttcatgtagttattctcccaatgatgaacctttagatcattgccaatatctcactgctaccagcaatgctgctaagataatcttgactatactttcttgcacacacatgcaaatgttttggttttaacagatatgtcagatgccctccaaattgactgtactaatatgcactccctttggtgggacatgagggtacccgtttgtccaactctggctaacatttgttatcaaagttaaaaatacttgccaatctaatcagtaaaaatagcatctcaatgaccttttatttgtatttccttgataaatggtgagatcgagcattttttctttcttagcaattttaatttccttgaatagtattttcatatgaattgcctatttgctattcatttgatttttttcttattgcccatttattatgaacactcatttgtttggactttattatctttgtgtctttttttttttttttttttttttgagatagagcctcaccctgtcgctcacgctgaagtacaatggcatgatcttggctcactgcaacctccgactcccaagttcaagtgattctcctgcctcagcctccaaagtagctgggattacaggtgcccaccacgaagcccggctaatttttatacttttagtagagacagagtttcaccatgttggccaggctggtcttgaactcctgacatcaagtgatccaccctcctcagcctcccaaagtgctgggattacaggcatgagccaccatgcctggcctatctttgtgttttttattgatgatgctctgtttctctttttgtccccattcttgttttctgttgggttgattgaaatttctttgttccatcttatttccactactggtttgaaatttatacatttcattgctatttttctaatggttactcttaattttttatatccatatataatgttgcctaacaaaatctgaaggtaaactgtacatatagactcttcccaaacaagataagaaatgttcacttcctccccctgttttcctttttcccaagtctcctgttgatataatccagaattctaattccaaattgttattttaagcatccatggcaatcaatactttagtcttaaataatagcattggctgattacttagggaagtgttacttttttcgcactccttcttcctctggtttcatgtcatttcttgcaggagggcttcttaagtagttgttttcaacagaatctgttggtggtaaactttcttaaatcttgaatgttcaaaaatgcctttgggccgggtgcggtggctcacgcctataattccagcactttggtaggccaaggtagtcagatcacttgagcccagaagttcaaaaccagcctgggcaacatggaaaaaccccgtctctacgcaaaaacaaaatacattagccaggcgtggtggtaggttcttgtagtcccagctacttggggggctgagatggaaggatcgcttgagccaggaaggtcaaggctgcagtgagccttgatcatgccactgcactccagcctgggcaacagagcaataccctgtctcaaaaaagaaaaaaatggctttgtttcactgtgcccttaagtgattctgtagctgggttatagaattcagcatcaattagttattttccaaagctcattgaagacatggcttcattggcctgtatctagtgttgctaatgaaattaatgaggaaaatctgatccttatttctttgaatttaaactatttttttttttttttttttttttgctttggtagcttttaacatttttttctctattttcatagctttcttcacttttggggaatttttagctattaattaaatactactttctcccattctctctctgcctttggaattcctactagacgaaagcttgaatgcggtcacccagactttctggctcttaaccttttcacctttttctctttgttctttaacctgcaagactccctcaactgaatgctccattttgctaatggacccttcagtgtgtctctgctgttactcagcctatcttttgaggtttttctttcaataacttgggctttaatttttgagatctctaattggttctttttcataattgcttggttttattttcccctgttttgctgaaggtattaaatgtacttgctttaattgacctttggttgtagagaagatttttcatttgctctatttgttatttctctttcatagcagtgggcttcctcagacatctggcacttcttcaatgcacactagatttctggtttccaattctccacctgagtctcaggattctgcagcattcccaggtgggtgcagactcaggttacctgggccttggcttctcccatggcttcttaagaacttccttgtttatttctgtgatcccaagcactcccctttatgacttcaagcccaattgtatagtcagtaatttaatttctctatctgttctatcatttataagggcacagcatggaggggagggcctttcagatatttttcttgccccatcttaaatccctaaattacacttaaaaaaataccaccaaagcttttgtcttttatttaggaagaatagagtactcagacatgagtttggagtaggcgggtgtatgtgtgtatgtgtgcctatgcagtttaaacctgttctgtaatgtattgcaataaatgtttcagtgtcggtacagtgaacaattcaacttcataataggccaatctggaatctcccagaaaaatttactttgggtgttagtgctttttttttttttaatcattaatatctataggaagacctagtaggagtggctgacaaagtttaataaatctcatgataaaatgcttgtttttgatgtgaatgttgttcctcagtccatcctaaaatgaaattcacagggttgggttcgatgtcttcttccacacctctcattacaatctgccataggagtgcagaccgcccccatctgaggcctggatttaatgctcaaacaagacagatgccagcaggaaatatttgccctgccttcgctgtaaatcttgagtccttgtccatgatatcctaaaaggccaccagatggaaatgtgatgccgtgaaaagagatgcactaccctttgcaaagggggattgaccctgctgctctctcaaaagaaattgtccttattcaatgtaaaacaaggttttagaaatttttctttgttgaatgtagaataaagagggcattacatgaatgcctatgcatttcagctttggagaggaatccttacatccattctgacagcatggagataaaaagtctgtctttctgtattcatgttttgttgtcatttgctttcttttctcccttcttggtctgtgtgtaccacatcctctctatgtcttctctttctttcttttttttttttttgagacggagtctcactctgtcaccaggctggagtgctatggcatggtctcggctcactgctacctccgcctcccgggttcaagcaattctcctgcctcagcctcctgagtagctgggactacaggcatgcaccactacacctggctaatttctgtatttttagtggagacggggtttcaccatgttggccaggatggtcttgatctcttgacctcatgatcggcctgcctcagcctcccaaagtgctgggattacagatgtgagccaccgcacccggcctatctcttctcttttttgtcctctcctttgttacctggaaccaacttttcatccctctggcctttgtctcttcctattttctggccatatgtggatcagaaaaataattataaaaatgatttgttgttttacttactacaaatgtatgatttctgttttcattgcaaaagccaatgggtaagaatttttaccattccttcactgtaaaaaataaaactgagggccggtggcggtggcttatgcctgtaatcccagcactttgggtgaataaggtgggcggatcacgagttcaggagactgagaccatcctagctaacacagtgaagccctgtctctactaaaaatacaaaaaaaaaataaaattatcggggcgtggtggcaggtgcctgtagtcccagctactcgagaggctgaggcaggagaacggcgtgaacctaggaggcggagcttgcattgagcagaaattgtgccactgcactccagcctgggtgaaagagtgagactccgtcttaaaaataaaaaataaaataaaaataaaaaataaataaaactgaggccaggtgtgatggctcctgcctgcaatcccagctacttcggaagccaaagcgggaggattgcttaagcccaggaggggttgaggttgcagtgagctatgattgcaccaccgcactccagcctgggtgacagagcaagatccttactcgaaaaacaaacaacaaaacaccaaacaaaaagctcctgcattctgccaaaactaactgaataattttaaaagtattttattgagttataataatccaaccaaaaattgtacctattataactgtatgtctcactgattcacaaataaaaaaccacagtcatttaaccagtactcagattaagaacaagaacattacctgtacgcctgaaacccccatctgtccccatccagtctctaccttcctcttacccaaggacaatcatcacccagacttctaatagcacagaataatttcacttatttttgtgctttataaaaatggcatgaaacgtcctagtttgggttcccctaggagctgccctgagacaagtatttggcgacagttcttttatctggaggcacagggaacactgagtggggcatgaagaagtgagccaggaaaaaggcaggcagcagccataaagaaaaatgtgttaccaggccaggcgcggcggctcatgcctgtgatctcagcactttggaaggccgaggtgggcagatcacttggggtcaggagtttgagaccatcctggccaacatggtgaaaccctgtctctaccaaaaatcaaaaaattagctaggtgtggtggcaggtgcctgtaatcccagttacttgagcagctgaggcaggagaattgcttgagcccaggcggtggagggtgcattgagtcaagatcacaccactgcactaacagcctgggtgacatagagaaagaccctgtctcaaaaataaataaataaataatttttttctttcttttttttggagagacagttctcactatgttgcccaggctggttttgaactcctggactcaagcaatcctcccatctcggttctcaaagtgctgggattacaggtgtgagccaccatgcccagacattttcatcattcattttttttttttttttttgagacggagttttgctcttgttgctgagactgaagtgcaatgtcaccatcccggctcactgcaacatccgcctcccaggttcaagtgactctcctgcctcagcctcctgagtagctgggattacaggcatgagccgccacacccagctaattttgtatttttagagtacaaggggtttctccatgttggtcaggctggtctcacactcccgacctcaggtgatctgcccatctcagcctaacaaagtgctgggattacaggcatgagccactgcgcccagcccattttcatcattcctaatagccatggagcattccatttaatcaactgtatatgcatttttttttccgggggcaaggggctcatattcacacacatgggaggccagttggtgagaaggtggcaggcggcatagccaccttatacagcatgccatactggtccactgtcagaccggtgatggccacagctccatcaccccccatgctgactctggctcctgcctggctctgcccggccaccacaacccctcgggaccattcagaggcatcactggagggtgtgtggttagtggagcagctggtcatggggaggtctcgtttctttggtggaaggcattcctgactcctctcatgaacaggtttcatattgctttgtggtgttcctggagcctggaaggagttggcttgctccctggggcatcaggaggggcttctcggtagcttccctgtacccctcactgcttctggctggggcgcccacatctgagcttccagtggtgcttctgaacagctgtagtaagcgtcctcccggctggctcgggagccagcccgtttcacagcgcttcctgggatccacccgctcatcctgcagccgccgcaactgcagccgccgtcatcccggccctggagcccccacacacccctgtgtatgcaatatttgttaaccattcccttttggtgcccatctaggtacaggtctcatttttcaagctaaagtatctgtaatacactggaagtaatagatgtcacctccatattgtatgccaaacctaataagcagagcaaaacttttcatccaagtgatttggttaacattttaggatgtttctaatctctcagtaatacaaatatgctacaatagatctgtgtgcttatcctttgggcacttgtgtgtacctgtgcatacctggagaataaagtcctgtgagagaaactgccatccaaagagggtgtttcagtctgtactgccaccaacaatgtgctcgtgcctctgagcttgcgtttgggtcaggagaatttgaaagtcatcaggaaccaaaccaggatataaggttcagctgcagctggaaagtggcaaacgttccaaagctaagacattggctattcctgggctgttcacaaactgtgaggccaattctagatgagatccagaaaaagggtgagcagctcacttattttttaagcaaaacaccttttcttctcatttctgctaagaacaaatagcttccagcaagataaataggggatgcaatatttttacaaattatttctttttttattaaaaaaaattttaggttaaatgcgacttaagatatgtttaacctctatgatactgacttgctcatgagaagaaagagagagggccaggcattcttgcccactactacccactatcaacacttaggcctgacatcagtctctaaataaatattctgggccaggtgcggtggctcacgtctgtaatcccagcactttgggaggccaaggcaggcggatcatgaggtcaggagatcaagaccatcctagctaacatggtgaaaccccgtctctactaaaaatacaaaaaattagccaggtgtggtggcgggcgcctgtagttctagctactcaggagactgaggcaggataattgtttgaacccaggaggtggaggttgcagtgagccgagaccatgccactgcactcctgcctgggcaagagagcgagatcccatcttaaaaaaaaaaaaagaaagaaaagaaaagaaaagaaaagaaaaaaaatcaacagaggcttctaggatgactgagcagtgactcagtctctccttgatcagattctgtaaccatccagcagaaaagtttacctgatctgtgggagaacaggaagcagctcagtgggggccttccttgctaaattcttcatcaagctggtctgttatctgccctgagtcctgcaagaacatctcaagaaaaatcccaaaaacatgcaagacaaatgaaggtcctcccttagcgtgttcttgaagcactgaggtgcctgaaaactatatatactttctggggaaacagttttttaggaaatgtagcacagacactaactattcttccaggagagccccttcctgacatgaaagatcttagcatgagagagaagcatctgattcatcatggggacatatccaaccagcagcaggggccccagtgccggtgtccacctcagcagaggagacacaggggacatgaaaagtgtttccattgaaaaaaacttcacctagggtgactatagttagcaggaatgtattgtatatttcaaagtagctagaaggctaagtgtggtatcccatgcctataatatcagcattctgggaggcgcaggcaggcagaacacttgaggtcaggagttcgagaccagcctggctaacatggtgaaaccccgtctctactaaaaatacaaaaaacaaaaaataaaaaattagccgggcgtggtggcctgcgcttgtagtccaagctactcaggaggctgaggcaggagaattgcttgaacctgggaggcagaggttgcagtgagccgagatcaagccactgccctccagcctgggcgacagagcaagactctgtctcaaaacaaaaacaaaaacaaaaaaacaaagtaactggaagaggggacttcaaatgtgtccaacacatagtaataccaaatattcaaggtgatggacaccctaaacaccctgattgatcaccacacattctgtgcatgtaataaatactcaaatgtactccataaatatgtaaactattttatatcaataaggaaatactttgcctagcgtttccatccaaatgggaataaatccagggctctacgtacatatttcatggctttttattgagacttgggaagggtgggccatggtagcaggtgcattcactgtccaagtttgcccagactctctgctgcatgggtgatggcatttgtgactgtgttggtcactgtctcagtgacttccttcatctttttgtcccctgactcttgggctttctttatggcttcggcaatggctgttggaaagaaagaagaagaatgtcctagtgatccacccactgaacttgtatccccttgagtggcctgtgggatgtggccatcttaatggattagtccatggagtggcccaatgggaccaaggggagcaggactcctggcagaatgaatttgaatttggttttaatttccccaacaacttgtatttcttcaactctgagactgagcatctactcatgggtacattgcctgcttatcctttttttctggaaaatgcctgcttatgtcttttggccatttttatgttgggttgttatattgcattatcatttctattacaaatatttttcatagtttgtgatttttcttttggcttggtttatagtattttttttttttttttggctatagaaaattttgaagttttggattgtcaaatttatttaatatttcctttatggctgctgggttttttttccatagttctaaagattctcccctctccaagattaggccaaagtctcttatgttattactatgtctaaatgtttatgatgtcttccccctcaagactcatacgttgaaatcctcagctctaatgtgatggtattcagaggtggggcctttgggaggttgaaattagcacccacataaaagagaccacagagagctagctccttccacaatgtgaggacacaactaggcccatccacgaaccaggaagacgccctcaccagatgccaaatctgctggagccttgatcttggacttcccatcctccaggagtgtgagaaataaatttctgttgtttctaagtcacccagtttatggtttgtttttgtttttgtttttgagacagagtctcgctctgtcacccaggctggagtgcagtggcacaatctcagctcactgcaacctccgcctcccaggttcaagggattctcctgcctcagactcctgagtagctgggattacaggcatgtgccaccacacccagatgatttttgtatttttggtagagacagggtttcaccatattggtcaggctggtctcgaactcctggcctcagctggcccacctgcctcagcctcccaaagggctgggattacaggcatgagccactgtgcctggcctatggtattttataatagcctgagctaagatagttatctcctataagttaataaattcatgtatgtaaatttcagtccttcatctacccagaatctattttgttgaagaggaatgagatatacacatgcttgtacatagttctactcatagctcacacacatcaatttgacatttaacatataattttacatgttaaatgttttgtcccagtgtgctgtcacatagtcttttgtgactttgtcttcttatcattccatggagagaaccatctagacagtgccctaacatagtacagtctgtggcctctgatgaacatagataactgtcccagccgagaggctctgaaaggctgcaacattaggtgcagagtttgacccggttagtcaaagaacaggttggcccagcacctagcttcccttcctccctccctccttccatgcccgacctcagccagctgtacctttctctccagtctccttggcatgtcccaccacctccttcaccacttcctccatggcatgaactgaacagaggagacaagtccagggtgagggctcagagcaggcccgctgcccccgagtccaggatgagggctcagagcaggcccactgcccccacagcccagggtgagggctcagagcaggcccactgccctcctgagtccagggtgagggctcagagcaagcccaatgccctcccagtccagggagagggctcagagcaggctcatgtcccctgagtccagggtgagggctcagtgctgacccatttatcctcacaatggacctatacgtccctggacatccaaggtggggctccgggatgccacccccagccaggacagactggctcattagaaggaacttcccccacagctgccttcatttggagatgccgggacactggctgatgggagacaagctcagtgagccccatgagggcatgggcccctgaagccccttggccctgcccagcctggaatgtcaatgatcagactgtcttgccagctgagacctggagaccaggctaggcctctgtgccagattacatccctctcaggatgtgctggcgcctgcctcaggttaatttccaaagcctcatccagtaaaaccatgtctctcaaagcaattcctccaacaagagggaattctctgcctacttcagagttttttaaagtgtgggtggtagtgtgctagaactgaaagattttggagtcagaagaaatggttcttattctaactctcccttccacctcttggttccctcatctttagaatgggaatctgttgggatgatcagagccaacaccaggtcgtgggggcaacaaagtcccgcggagtcaaaagaatgagaaaaagttcaagagagaaagtgggaccagggggccattgccagtgtggaggctgcaaaggcactgagctctgggagcccatgctatttattggtgatctaacaaagaaacaggtggtgaggatgtggaggttgaaaggaaacagtgtagcaagtgaatgagaaatatatggctacttgagataatgggaatgctggaatcaagaagccagcaagtctagcagacatgcaagccctgcctcagcttctctaccaacactcagcttttctcccaacaggaatcatagaaaactcagaggctagtgaaaggttaaagcaggtggttatcaccagctgcagagtcaaaaacaaaatacacatctgctgccatgtagaaagaggacacaaactcaggcaaggctgtttttcacatgatgacccatgagtggggcctggctgggcctccccacacacagctgctgacctctgcatacaaaacatgcttcggcccagaagcacgccagcattcacccacctgtgggtatcagtcaggctcctggtggaagccagaggacatattcgaatgggtacttgaggaaaaggggctgttcacagaagtgtggacagagttaagggaaccaatgagagatgagaaatgccctggaccagcaagagtgggagctgttatctccctgggtctagagggacaggaaaggtgtccacagaccccgaagagagctgtggctgtaggggaggatcatcaggagctgcagccatcactagaaagatgtggccactggcaaaccagcaaggaagaatctgagtgaataaccacctctcctctctctcccacctcctatgacatcccccactgtctgaattccactagggccagacagtgaggaaccttggtgatgcagtccaagagggagtgggcagagaggagccagtgggtatggaggggaaacagagaaacagagaattccagctcactctgcgggatttctgggtctgatagaaacatagcagcagcttaattattattattttgagatggagtttcactctttttacccaggctgaagtgcagtagcgtgatcttggctcactgcaacctctgcctcctgggttgaagagatcctcctgcctcagcttcccgagtagctgggattacagggacatgccaccacacattgctaatttttttattttgggtagagatcaggtttcaacatgttggccagactggtctcgaactcctgacctcaggtaatccgcccgcctgggcctcctaaagggctgggattacaggcatgagccactgtgtccagcctgcagcagctcaattttacagtgtcccttttctccttctggaaactatatagagcaacaacaagactgaggaggaggaggaggagaaggaggaagaaaaagcccatcatcaacatacacatcaaactcaacttcagagaaattaggaagctgggaagccacgtaaacccaaaagcaggtgacaccagcagaaccaacacaggaagccagggaagtgcagaagaacagggcatggggggccacccagggggaatcttcactgttgccagcaacacacactcccagcaagagaggaccctcagagtgagaacgcagagctggagaagtgaagaaaaaaggaacaggtggtgtgcggggaagtccaggggtgcgggatctgacagcgtcccttcccaagagaggcaggaacacttgggaaggcagggctgagtccctggaggctgtatccgggaaaggaagctggcagtagaaccttcctgaagccgagttggttctgagaggcagaggggcagtggtacaggtgaggccgacgcttctgtgcaggaagggcaggctcctgaggaagggagccccgaatgctctccactagattcccagggagtcccactccctccacagggaccttgcgctgacatctgggaaatgccattcatactggaacctccgacacactgccatgaatgtgagggtttcgtgactgatggggtaggtttctcttttccaattcaatagtataatttccatttattcctcccccagcctccctgaacattcacatcttagatagccacagtacggtgatcagaaccaggaaatccacattctcatatttaactatattaaaattatttcacaaaataaccaattttgttaatttaaatacatttaaatgacgtttaaatgtatttaaattatttaactatttaaaaatgaacatattagctaaactaaagaccttattggagttttgccactttttccactaatgtcctttttctgttcccaaattccacccaggatcacgctgcatttagttatttctcagtctctcgccgttttgtaggactgcaataacagttcctcaatctttccttatctttcataaccctgacatcttgaaccagtactgatcactatttgtcaaatgttcctcgatttgggtgtgtctgatgtatttccatgattggactgaagttacacacttttggcaattacagcacaaaaatgatgtggaatccttcccagtgcattccttcagagttatggcattgatagttcttcttactgatgatgttgaacttgttcatttggttcaggtttctgctggatttctccattgtaaagttactatctttccccctcatagggggaaagatcttaggagaaatacttggagactatgaaagttttgtattttctcaaactttaaaattttttttcaggccaggcgcagtggctcacgcatgtaatcctagcactttgggaagccgaggcagatggctcacctgaggtcaggagttcaaaaccaccctgatcaacatggagaaaccccatacctactaaaaatacaaaattagccaggcatggtggtgcatgcctgtaatcccagctactcaggaggctgaggaaagagaatcgcttgaacccgggaggagaggctgcagtgagctgagatcgtgccattgcactccagcctggataacaagagcaaaagtccatcacacacacacacacacacacacacacacacccacaaaaaaaaaaaaaaaaaaaaaaaggccaggcacaatggctcacacctgtaatcccagcactttgggaggccaaggtgggtggatcacctgaggtcaggagttggagaccagcctgaccaacatggagaaaccccatctatactaaaataaaatacaaaattagctgggcatggtggtgcatgcctgtaatcccagctactcgggaggctgaggcagtagaattgcttgaacacgggaggtggaggttgccgtgagccgagatcccgccattgcactccagcttggccaacaaaagcaaaactccatctcaaaaacaaacaaacaaacaaaaaacacctattttgacagccgggcatggtggctcacacctgtaatcccagcactttgggaggccaaggcaggcggatcacctgaagtcaggagttcaagaccagcctggcgaacatggtgaaaccccgtctctactaaacatagaaaaattagtttggcatggtggcatgtgcctgtaagttccagctacttgggaggctgaggcaggagaatcgcttgaacccagaaggcagaggttgcagtgagccgagacggtgccattgcactccagcctgggcagcagagtgagggatctcaaaaaattataataaaaaaataataattctattttgaatagtggtaaaatacacataaaatttactaccttaaccacttctaagtggcagttggaacaggggtcaaggagagcccttgggttgggtaatgtatattcacattgccatgcaaccaatctccggaactttctcatctgacaaaaccaaaactctatatccactaagcaacttcccattttctcccttccccatgtccctggcaacccccgttctaccttctgtttctattagtttgcttactcagtctggacgcttcacataagtgaaggaacaccgtatttgtctttttctaactggcttatttcacttagcataatgtcctcaatgttcatccatgttgtagcatgtgttagaatttccttcctttttaaggctgaagaatattttattgtatgtatataccacattttatcaattcatctgcctatggacaattcggctgcatccatcttttgacgagtgtgaataccactgctataaatatcagtgtacacatatttctatgagaccttgctttcaattattttggctatatacccagaagtgatattgccggatcatttggtaattctatttttaattttttgagaaactgcctgtcctgtgctgagcaggtctatataaacctatctgcaaaggccaaggaacctgagataccaaagaaagaggctgacaaatccagtttctcagaaagaaacatttaataggcgtttatgaacagaaggcaagtcagggatggcaccaagataagatggtggatccctgtgccatcacccccacccccccgacccagggcttctatagcatagggaaagggtaatgcgggcttcagcagggatgtgtatggccagacacggtggctcacgcctgcaatcccagctctttgggaggccaaggtgggcggatcacctgaggtcaggagttccagaccagcctggccaacatggtaacacctcgtctctactaaaaatacaaaaattagccaggcgtggtggcaggcgcctgtaatcccagttactcgggaagctgaggcaggagaatcgcttgaacccaggaggtgaagtttgcagtgagctgagattgtgccactgaagtccaacctgggagacagagtgagactcagtctcaaaaaataaaaaataaaaaataattttgttaaaaagataaaatagaaatcgtagatgaattcttggaactgggattaatcagaacatggcagattagcatccaacatggaattgctttattctcattcaaggtttccctcattcttcactctccccatgctggtcaccttgctgtttgttcctcaaacacatatgacatgcgtttctgtcttggcagtcatcctgctacctgtaatgtcagcactgctttctgttgtcccttcagtcaggtcactgttcaaatagctctctagacaggctcttccttatcattctacttaaaatagcccccaatcactctgtgtccctttagcctgcttcctcttcctgctatttcatactacctgaaaaaatacttgtttgaacttcctagaacataagctcataaaagcaagaactgtgctccacctctcctctcctctaccccagcactcagaagagcaacagagtcagcatccagtgagtgttcatgaatcaagtcactgcttggcagaattcagcactgggaccacagcctcgcctatcttcaactctttctccttctgcttttcctcctcccactctagtagccactcttctgggggcttgtcccttaaatgattagtccttactgacctattttctgtccactttatctgtttttgagagagggtctcactctgttgcctaggctggagtgcagtggcatgaatatgggtcactgcagcctccacctcctgggctcaagtgaacttcctgcctcagcctgccatgccatgtaactggggccacaggcatgtgccaccatgtccagctaatttcttgatttttttttggtagaaatgggtctcactttattgcccagtctggtcttgaagtcctacactcgagcagtcctctcaacttggcctcccaaagtgctgggattacaggcatgagatactgtacctggtcttattttttcttttcttaagatacagggtctcaccatctggcccaggctggactcaaactgctgagctcaagtaattcccccatctcagcctccaaagtagctaggactaaaggcatgaaaacaccatgcttggcttgtcccatttcattctacacactttcttggtatttaaacagctgctgttgctcttcattctgtagctctacatcagattcatgctctagtcctgtatatcaaaatgatgactagaggctgccggctccgctctttcaaaggcacaatgagcgtagcccgtctacaaaactctcccttttccaatccagctttccctcctgcatcacctatctctctacatctggaaccatcggcagctgccttcataaggcacctcggtctggcattcggaaaacaaccctgtcttgccagagcctcctggtcttgggtagcaaaagctgtatgcaatctaaatcaagctttcaatcatgagaaatcacattccttcttttccctttgtaatatactcatgtgtttttttttttccctttctcaatcagcaaattgtaccaccatcttattctgagatgctcctttttaaaagctgtagatcacattaatggaagtgtttactgctgggaatattttccatgtgcaatgatctgtaaccctctttttcttttcttttttttgagaccgagtctcgctctgttgcccaggctggagtgcagtggcacaatctctgctcactgcaagctttgcctcctgagttcatgccattctcctgcctcagcctcccaagtagctgggactacaggtgcccgccaccatgcccagctaatttttttttttttagatggagtctcgtttggtcgcccaggctggagtgcagtggtgcaatctcagctcattgcaagctccgcctcctgggttcacgccattctcctgcctcagcctcccgagtagctgggactacaggtgcccgccaccacacctggctaatttttttttttgtatttttagcagagacggggtttcaccatgttagccaggatgggcttgatctcctgaccttgtgatccccctgcctcagcctcccaaagtgctgggattacaggtgtgagccaccaggcccggccatggccagctaattttttgtattttttagaagagatggggtttcatgatgttagccaggatggtctcaatctcctgacctggtgatcagtccgcctaggcctcccaaagtgctaggattacaggtgtgagccactgcgcccagccaatctgtaaccctcttatctcaactaactgacattattacttcacatccagttcaatttataaattaagagaggtgccatgggccgggcacggtggctcacgcttgtaatcccaacactttgggaggccgaggcaggtggatcacgaggtcaggagttcgagaccatcctggctaacatggtgaaaccacgtctctactaaaaatacaaaaaattagccaggtgtggtggcaggcacctgtagtcccagctacctgagaggctgaggcaggagaatggtgtgaatccgggaggcagagcttgcagtgagcagatatcacgccactgaactccagctggggtgacagagcaaaacatcgtccaaaaaaaataaaaataaaaatgaaaaagaggtgccatgtgtacaaaaatcaatgcatatttatgaactttatttcaaatatattttcacacattttatctaaatacataatacagaagcctgtgtgacttgggcaatgtggccaggagggcctgagactaacaaatccaccttggcaaaaggacataaaatacgtcttatggtcagaaaaatcaacattttgtgtatttacttagtttacgaaaagtactgaaaatgctattattagctgaatttgtgatttccttttgaaattctgagttatccttatttttcccattttgtttttgcaccaaggagactgcagtcaaataaaacagatactacacacacttgtcggggcagccgtactgcagaagcacgttgatgcactcctggctggaggcctgccgggcgtaggtcagcgctgtgttcccgtgggcatctcgggccatgacgtccaccccgtaccagatcaggagctgcgccaggaccacattccccttgcggcaggccagatggagcgccgtgcagccgtctccctccccacaggtctcgttcacctcctcacgggagccatgtgccagcagcaggatggctgtctgcaggtcctcatcagcggtggcccgcagcagctgctggcccagggacagctcagtgcagggtagtggggccagaaagagcttctcctcatatttggaacggatccaccgttccttctcttccctcgtggacttttctgagggttttgtctgcccctggctgctcccttcccagatgctgttggctaggtcattgccaatagatgacataaccttcctgagctcaactggccagtcatccagctccagagatcgcacacgggaaaggcgggtgccaagactgcggtggattcctgagcattcaatacacatgaggactcccaagttcaaactggcccacttaggattctgggtctcacagtccacacagtgggcgttcccacgcatgttttggatcgactgcagggccatggccttgctctggctggtcagctgggacttgcttttactgctctcgcatgactgcaggctggccaggatctggctctggatggcttggacccaggcatcccgctcctcatacgtcgtggcttcaaagtgccacgtttggccagtggcagacacaatcataaagttgttggtgcttttcttctttaggtgtttctttttattggcatgaggagaggggggcgggttgagcttggggctggtggtgctggagatactggggctgaagcatatggagtcacccagcccggtgtccatgtccttggataggccattgcttttagaggtggagatgggtgtgcaggccgatgtggctagggatggccactttcctgggactttgatggtagatgtctgaaggtcaatctcttttttatgaatattcttcatataatcacctaagcttgaataataggtgagcacgccattggaacacagggtgacgtatttctttttccatgtcttcagccatttcccacttcgctttaagagcatgccctgtttaatggggatggctctgccgctcccgatggtgtcagcatgattctccggggctttcctctctttgtctgggtcactccctttctcagatgtaaacaggttggaccagcgcatggaccgcttgcaaacgggggtgggtgtgttggcagtgggaggaacactgaactgagggtcctcctggctggtgctgggagtcgatggaatggaggaggaatagttatttaaactcccacctccatttcttttcttcataatgtgcacggtggaaacctgtgtggaacagaaggaggaatggcttcaaaaattgggtagtggcttgcagggtcctatagacagctcacaattaccttttaaaaagatacattttctgggccaggcatggtggctcacacctgtaatcacagcactttgggaggccaacgtgggtggatcacgaggtcaggagttcaagaccatcctggccaacatggtgaaaccctgtctttacaaaaaaaaaaaaagaaaaaaaaattagctgggcatggtggcacatgcctgtaattccagttactcaagaggctgaggcaggagaattgcttgaacagggacctgggaggcagagcctgcagtgagccaagatcgcgcgattgcactccagcctgggctacagaaagagagtccataaaaaaaaaaaaaaaaaaaaaaaagatacattttctgttgtttggatagtatatttactcatactagctcactaactaaacagagctgcagatcagttcttactccagcacattctttttacaacacttaagatgactaaatgcaacatgaaatggggaagatttaaaaaaagatggctttgacttcagcatgaaacagatacaagtgtacgatgaaaatacaacctcaataaaagtgccacttaccgcaaatgagtgtaactgttcatcaggtatgctcaaagatctatctgcatctctataaaataagaaagcgcattacttcaaaaactgttaatatcttagtataatatttgtttagtaaaatactgcctcctgtgtgctttggtgtttactttaccaaagcagtttttacgaattcttctcttggatcctgacttgcagagggtttcctgacttcttctttctcagcacatcatggcctgtaccgtgaagtcttttatatgataaccagtcagaaatgcccgtgagtattgactctccctaacaggccatggcaataaaccaaacatattttcactcttctaaccacacattgaaacacaagaatgttctacaaagcagttgtagtaaactttaataaatgtaaatgtgattcagatttcctagcttcctttctctttagttctctgtagtatactctcatgatgtatttatgtactttctgttgtttgaatgacaaactcatctgcctttttaagacgccagtctttgatgaactttaaactttgtaaaactaatgcattgtgcctgtgtataaaccagtggttctccaaatgtgctctgtggacctctcgggatcccgaagaccccttccagaaggcctaagaggtcataactgttctttttttttttttttttttttttttttgagaccaagttttactcttgttgcccaggctggagtgcaatggtgtgatctcggctcatggcaaccttcgcctcccaggttcaagtgattctcctaccccagcctcccaagtagcagggattacaggcacctgccaccactcctggctaagttttgtatttttagtagagatgtggtttcaccatgttggccaggctggtcttgaactcctaacctcaggtgatccgcttgcctcggcctcccaaagtgctgggattacaggcctgagccactgtgcctggccaacactgttctgaatcatactaattaaacctgagaaagctgatgaaaaattttaaaaatttgtgaaagtaatacaaagtcattgcctgctttttcattgacacttgccatgattatataaaagcaaaagtgggtacaatggctggtttctcagcataaatcaaggcagtggtaccaattacattagtagtcattctattcttcactgtcccctacaggtaaaaaacatagcctgaatttcttaagaatgtctttgatgaagcagtaaaaattaatgttgttaaatcttgacatgtctctaatattctgaataagtggaaagttaaccagaagcgctttttttttttttgtttttaaagaatccgtgatttaactgtgaactgaaaaatcacttttttcacagaacatcatttttatttaaaagtacaactgggccagcgcagtggctcacgcctgtaaaatcccagcactttgagaggccaaagcaggcagatggcttgagctccttcaggagttcgagaccagcctaggcaacataacgaaaccctgtcactgtcaaacatataagaaaattagcctggcgtggtgccacacatctgtggtcccagctacaaaggagcctgaggtgagaggattgcttgagctgagatcatgccaatgcactccagccaagtgacagagtgaaactcggtctaaaaaaccagttcaactatcattctcaaaaataaatgaagtgagaggttgtcacttcaagggaaatacgtatttgttcccaatgataaaatttaagctttcctgtggactttgaaaaacttgttccttctactgtaggcttggcagcttttcaatacttaaaggcgtgttaaagaaagattggtggttaaactaaaagtgatttttgacacaataaaacataaaccaatatattccaagtaactaatgcatgatattataaatgcaagtatggagcaaaagatccatttactgtgcaagaaagatcaatgagtactgatggaataaatttattaatatgtaaaatgccaccgtaactaatttaagaaaccaccacttgtgaagttttgatttagtgttaacaaatacccacaactgtctgaaaactttaaaaatacaccttctaccaactacatatttgcatgaggttaggtcatcttattgcttctttttttctttttttgagacagagtcgctctctgtcacccaggctggggtgcaatggcgagatctcggctcactgcaacctccacctcccaggctcaagcgattctcctgcctcagcctcccaagtaactgggactacaggcatgcaccaccacgcccagccattttttgtactttcagtagaggcgggttttaccatgttggtcgggctggtctcaaactcctgacctcaagtgatccacccacctcggcctcccaaaatgctgggattacaggtgtgaaccactgcgccccaccagcttattgctttttttgtttgtttgtttgtttaggcagagtcttgctctgtcacccaggctgcagtgcaatggcaccatctcagctctctgcaacctccgcctcccaagttcaagcggttctcctgcctcagcctccagaataggtgggactacaggtgcgtgccatcatgcccagccaagtttttgtatttttagtagagacggggcttcgctgtgttagccaggatggtctcgatctcctgaccttgtgatccgcccgcctcagcctcccaaagtgctgggattacaggcgtgagccaccgtgcccaacctcttattgctgctttaaagcaaattgcaaagaaagctctagagaatccatttgtctcctattaagctcaacatgagagactttaaataatataaatacatgacgcactttttactcaactttttgttgtagaaaagttatttttcaatgaaaaaattctgttaacaatactgttctcaaggaatattttctgttgttataacctgggtcatgggttactactgatatctagttggtagaggccatgaatactgctaaactctctgcaatgcacaagacagtcctcacaacaaagcattatctagcccataatatcaacagtggtaaggctgtgaaatcgaaactaaaaatagattttgaaaaaatttcaattgtataattctaccacactaaatatcaatataatcaatataaacacatactctttgagattctcaatcatttaagaattatgagagtcttaaggaacaaagaaaatacaaataatttgcttcaatattttagtaggcacaatacagcttatgatgtctagagctgtgacctaacactgagcttgatatcttgcaaagtacttagctagaataacaagacaggtttctaaaaagctcacctttgtgtgatatgatgaggtatctccaaggtcacactgtggaaggaaaaaaattcataacaatagatgttaacatttgttaggcctgaagacattttttaaaaggggggcagaggaaactctcctagtggccctgaaattcaaatcttctagttcagaacagtaccataagggcactttgttttcatttctttgttttttacaaaaatatgagaaccaaaatgcaaggaaatatgccgttagaagacgcgtttctgttggtgattacaatatataaataataacagatttccttgttatatgcttttctacccacgaaacctttcgtcccatgcgatttattttatgtatttatttattttttgacccagagtctgtctctcttgctcagactggattgcagtggtgccatcttgactcctcacaacctccaccacccaggttcaagcgattctcatgcctcagcctcccaagaagctgggactacaagtttgtgccactatgcccagataatgtttttttggggggtggggtggatggagtttcgctcttgttgcccaggctggagtgcaatggtgtgatctcggctcaccacaacctctgcctcccaggttcaagagattctcctgcctcagcctcccaagtggctgggattacaggcatgtgccaccacacccagctaattttgtagagtgaggctcaaaacaactgagggaaggcaaatctcaattctactaataggtctacacaatattagcactttttaaaaagcctgtaacattagcaggtaagatggatatgtctatagtgcttcaagtagttttcatctctgaaataattttaaaatcacagaatttaaagttacatgctggaaaggaccaatgaccttatgtgacatttaattcaacactcgttttacagatcagggaaacagaccttaaaactgacttgcccaaggtcccaccaaattggagcagtttctcgtcctaaactcaaattaagcagtggctgtcaaactttgctgcacattaaaatcgcctgagaagctttaatatctgcctcatcttccacatgagacattttaatttaattagtattgggtatggctttgggcatcaaggttcttggtaaacatttcccaggtgatttcaatcagcagcaaagtttggaatgattgagttggggtgaaaatcagaatcttctgggatgcttttcttcacagaaagatgcctcacatccatcccgattttcctaaaaggcttctcagtgcctagagatagagggaaagtggagatgggaagatacatgtgtttgcagacttgtattttgaaaaaaaccttgcataagtgatctcagcgagttccacctatcccactgacaacagtgcactactgattcatgataaaacatttttcaaaatatcttcttgaagccaatttgccctattaatttgttcaataactttatttcaccaatagtgaatacaccaaatgatcatttctcaaacttgctggtggcaaattaaaacttactatactctcaaaagtagacttctaaaaagtagaataatgaggaaaaaagcacgaaatttgtttcagcaaaattaatcttcaaagctgcttttgaattatatgctaacatatcaaaatctttggaactcagaagaagccagggactctagtcaaagtaatttttgtgtatgtgtgctcagagatttaagagacttagctgactacagacatttagtgattactcaataggtcccaaagctcaggacttgagacagagtttgagtccagtttttgttcgaaacacaatttcctctcaactattgttaaaagggagggaggaaagtgacattattatgagtgtaaactttccacttttaattgaagtaaaagttattgacaattgaattagttaaaaaggctagtgcatttgaaacaaaattgtttataagctagttatgtgtacagaatgaaaagttaaattaaagataaagacattaatattctaaattagcactttccaaactgtgttctaaaaatcaagactaataacccaagaagatgagaataatgtacactggacagcccctgtggagctggtggtggtgttggttgttgttccttttaaaataaacttcatctcagggtgctctcaaagcgcatctttgtggcccacgaggtgctcatgcacaatgggagaaattcaaatgcagatacactgtggtgccagaagaagaaaagctgttccttcttccaaggataatgtccaaagtagtgcacactgatttaggcctatgatgcattgaaaaactaagtttccacaaaaaacattcaataaagggaacctatccttctcactgtgttcaacattgtctaaaggcataaaggcatcaaaaagatacactgtttctgggattgcttctttgctaactgatttttccttccaccacgacgtctaagattaaaagagaaactgatacttaatattcagaatctggatatcaatatatggttgactccaatttcttaaactgattgctgaaaaggacaaccaaatgactgaaataattttagaataaaggaatctgtccctcggcagcatagttgtactcacgatattattgtcattgtaagataatgctggatggctgtgctgtcatcaaggaatattgtcgaacacaagctgtattgttgactgaaacgcacagtagatacctgaaggggaagggaagtgtaagtcaaacttatcaaagtgtattattttctcagttaaaatgtcaaatgacaaagcactaagatatgtcttacactccatgaaatgcctgagtgtggtatcatgtgcactctatagaaaacccattggaggctctcaacttccagagatgatgtttaagatatgggttataaaatgctgcccttaatatggtacctgtcatcaaacctaacaaggattttatgaattaccgttaaaaataatgggaaaagtcggcttcgcggggcacggtggctcacacctgtaatcctagcactttgggaggtggaggcgggcggatcacgaggtcaagagatcgagaccatcctggctaacatggtgaaaccccgtctctactaaaaatacaaaaaattagccgggcgtggtagcaggcccctgtagtcccagctacttgagaggctgaaacaggagaatggggtgaacccaggaggcggagcttgcagtgagccgagttcgcgccactgcactccaggccggcagacaaagtgagactccgcctcaaaaaaaaaaaaaaaaaaaaaaaagaaaagtttaaaataagatttcatttttttttctgcagcaataaaaagcagctgagaatttctattaattaattaatttatttatttatttttgagacggagtctcgctctgtcgcccagactggagtgcagtggcgcgatctcggctcactgcaagctccgcctcccgggttcacgccattctcctgactcagcctcctgagtagctgggactacaggcgcccaccaccgtgcccggctaactttttgtgtttttagtagagacggggtttcaccgtgttagccaggatggtctcgatctcctcacctcgcgatctgcctgcctcagcctcccaaagtactgggattacaggcgtgagccacggcgcccagcccttctattatttatttactacgataaaatgtaatgtattaaataatcctgctacaagagcattttattgcagtgaatacaagactaatgcatttactaaattactaatcctaaatgtattatttcaggtgatattgttacaaaagaagtgtttcagattcagaggctctgtgtgtcagggctgctaggccaccaacaagtgaggaagccataggtttctctagtcctattttcttatgtggaggataaaaagagtatcacttacatattctctcacaccctgaaaacaaatgacaacttaaaaaatctaactttcacttcatgtttaaataagactgccaagacatgactcaaatgagactctcggagaatactttgcattcacttcaaaacttgatcaattgcattctataaatcatctgacctgcacctagccattttcctgctctacccctgctctctgcctagaatactgcttttctctttccttgcttcagcaagctcgactccatctaccctcttggatctctttgtcggcagccacaccaaaaaatgtatttttatacactaattagttgaattcaccactgcttacaagatgctaattcctgcagagtattccccttgtgagaaagtatgcctctccataagagtaagggagggcccttactcttcctacctccagctgctgagcatagaattttgagtaaatccaaaacttcgacaagtgtttgacaattcagttatcatttggaaggtaagtcttactacatttaattacagcaaaaacactactaacagtttactctttataggtattatttaaggtagtcacaaaatagaaacaaacactctaacgtcaggcagcataaatgagagtatgaaattttacaatatttaacaagaaatggaaggggttacttagtagttttaaggtttaatgacaaaaactagaaaataatcgtacctagtaatttagtaagtcaaaaccaaagccttaccatcaaaggtgcagtacccattggatgcggatgcccacgcactgacttcttctgctgtacctgctgcctctcattttaacccattaaaaatactaaagttgttttccttgtagacatctttcacctccttggttaggtctattcccaagtattttattttagtttagtttagttttgcagctatcagaaaaggggttgagttcttggtttgattctaagcttggtcgcttctggggtataacagagctactgatttgtgtacattaattttgtctcctgaaactttgctgaattcatttatcagttctaggagctttttggaggagtctttagggtttcctaggtatatgatcatatcatcatcaaacagcaacagtttgacttcctctttactgatctgcatgccttttattgttttctcttgtgtgattgctctggctaggccttccagtagtatgttgaatacaagtggtgagagtgggcatccttgtcttgttccagttctcggggggaatgctttcaacttttccccctttcagtatcatgttggttgtgggtttgtcatagatggcttttattatattgagctgtgacccttgtatgctgattttgctgagggttttaatcataaaaggatgctgcattttgtcaaatgctttttctgcatctgtttagatgatcatgtgattttttgtttttaattctgtttatgtggtgtatcacatttattgacttgtgtatgttaatccatccctgcatccctggtatgaaacccatttgatcatggtggattatcttttttttttttttgagatggagtctcgctctgttgcccaggctggaatatgcagtgtggtgatcttggctcactgcaacctctgcctccgaggttcaagcgattctcctgcctcagccacctgagtagatgggattacaggtgagcgccaccacacccggctaacttttgtatttttagtagagatgggatttcaccatgttggccaggctggtctcgaactcctgacctcatgatccgtccgcctcagcctcccaaagtgctgggattacaggtgtgagccaccgtgcctggcccgattattttttgatatgccgttgggaactacaaaacgttgctgaatgaagtcatggacacaaacaaatggaaagacaccccatgctcatgaatgggtagaatgaatattgtgaaaatgaccatactgccaaaagcaatctacaaattcaatgcaactcccatcaaaataccaccatccttcttcacagaactagaaaaaacaatcctgaaatttatatggaccaaacaagaaccggcacagccaaaacaaaactaagcaaaaacaacaaatctggaggcatgacattacctgatttcaaactatactataaggccatagtcgccaaaatagcatggtactgatataaaaataggcacatacaccaatggaacagaatagagaacccagaaataaactcaaatacctatagccaactgattttcaacaaagccacctaaaacataaagtgaagaaggtaaaccctattcaacaaatggtgctgggataattggcaagccacatgcgggagaatgaaactggatcctcaactctcagcttacacaaaaatcaactcaagatggatcaaggacataaatctatgacctgaaaccataaaagttctagaagataacattggaaaaacccgtctagacgctggcttaggcaaagacttcatgaccaagaacacaaaagcaaatgcaacagaaacaaataggtgagacttaactaaagagcttctgcacaggaaaaggaacaatcagcagagtatacagacaaccacagagtgggaggaaatcttcacagtctatacatctgacaaagggctattatccagaatctatgaggaactcaaacaaattacaattacaaaaatatggaaccagctcaaatgcccgtcaatcaatgagtggataaagaaaccgtgatatacatacatatatatatatatatgaggaataccacctcagccataataaggaataaattcatggcattcccagcaacctggatggaagtaagactattattctaagtgaaataactcagcatggaaaaccaaatatcatgttctctttcatacgtgggagctgagctatgaggatgcaaagccataagaatgatacaatggactttggggacttgggggaaaggctgggaggagggtgagggataaaagactacaaattgggttcagcggatactgctcaggtgacgggtgcacctaaatctcacaaatcatcactaaagaacttagtcatgtcaccaaatgccacctgttcccccagaaacctatggaaataataaataaataaataaagtacagcatttttctcagcaaacataaaataaaacaaagactaaagttcatatttttcactctccttttgggcaggacaaattttagataggtttttaaagaattagtaacttttttcctttttccgagacagggtctccctttgttgcccaggctggagtgcagtggtgcaattatagttaactgcagcctcaaactcctgagctcaagcgatcctctgcctcagcctcctgagtaggtaatacgaaaggcgcatgccaccaggcctggctaatttgttatttaacctttttgtagatatgaggacttgcgatgttgaccaggctaaaaatgaacaaatcttaattaacttaaatatttctaacactttgggcattcaggaaaacagctccatctatgttgtgaagtaatgggaagtatatggcagtggataaactttgaatgaaaatattaaacaaggccttaggagaaaagtgtaatatgcttattatagatacattaatttaaaaaattctctggcttaatatcattaattatactcaaattagactttgatttaaacacaggtcctaaatttggattaaatataatagattgaccacaaatttatttcgtctccctccggaagcctcatcagtcataaaataaaggttacacccatgaccagcacagaaggttgacagagataatttttaataaatgctgagacataaaaagtagataaaggagtggtaaataacacagaaacacaactttggtgcctacagaaagtgactggaacagaagcgagccagtttgtcttgcagaactaaaggcaggttgtgaacttacaggcaaatggcactttggaaagtagggtaaaatgtgaaaaaaaaaaaaaagccagcaaggtcagttgcaaatctctaactagagccccaagtccacctgtccttccatctgacaagaaacttagatgtgtgttctctggatatatcaaacctgagaatttctggctcagagataccatggcttaaacctgagatataaagaaaactgtacaccaaaaatggaactccaactttcttcgctaactctgcttttcctttccaggcctgcttttactttccaggcagaaaactgggagatccttctcagaagaaactgaaatgtcttcaaaaaagatccccagataatacactgaggtctcccaaatgaaaagctagtcaggcttctaaggcctcacactgagtgctatcagttaacagaaatcctgcttccaaataaagcaggccaggaaccaccacacattggagggaagcctccaagaaaagagatcaaaacaatagaaaaaaggaattgataggaccagtcaaaatcaggagcaaaactttaaaaaaaaatcttaaaacactctcaaaaaatataaaattcaatagaaatagtagaggataaagtcacagaatatcccagaactagaataaaaagacaaactgaaaaaaatacaaggggaaaaattaaaaatcaatgcaggcgtactggtctaagcagcctagcatctgaataacaagactatcagtaaaaaagtaacagagaaaataaaaaaaaaaattctcaagaagagatagtctgcaggtttagtagcctcaataaaatgaaaagatccccaacaagctgttataaaatttcagaaccttagagagagagattctaaaaagcttccgcagataactaaaacctggttgtaaataacatatcacacactggcaatagattcaagaacaacactgtaataagagcacaactgcaaaatgtcttcagaaccatacaatttagattcaacctagaggtgtactctctatcaaagaggagggattttaacatctccacacaggaaaatgtgttcaagtacaactagagacgataacaggacagaaggaaacacagaatctaggactcaggcgatcccacacaagacagcagttacatgagataccaaaagactttaaagagttagcccagaaaagcagacattgagcatatctagggaaacccacgctatattgaactaggatgacaaaaggccaaagaaagttgccccccacacaaacataaaaaggaacagatgtgttttcgcagatggaaaatatctttgaaaggcatgtgataaatgctacaatacttgggggaaaacagctgttagaaaacaggcaaatgaatatagtcagaaaattagcttcatgctaaaaaataatggatgtgaaagcaaacagagcacccagaggctacttaacgatatttggatagataaactaacgtaggctaggaaaaaagaagatccaggagaattgcagaagtgctcagatttcagaactgtttcagagacaggatgaaggacatggaatgcagaggcacagtgaaaacaccatatgacttagcagtgaataatatttgcagagtcataatcatgtaaatattactgatttaattaaaaagtgtgctacaattggaagaaacacagggagaaacataagatcatggtgtagcggggaaggtatgcttttacctgctgtgacagaaagtcaatagacagtgctggcaattaacttagctattctatttttgttctttcattaaaaataagattaaatatttaaggcaattttttttttttttttgagacagagttttgctctgtcgtccaggctggagtgcaatggcgcgatcttggctcactgcaacctccgcctcctgggttcaagtgattctcctgcctcagcctcctgagtagctgagattacaggcatgcaccaccacgcccagctacttttgtatttttagtagatacagaatttcaccatgttggtcagggttgtctcaaattcctgacctcagatgatcagcctgcctcggcctcctaaagtgttgtgattacagacgttagccaccatgcccagccttaaggcagatcttttgaaccggactattgaaatttaacttaaatgtcagaaatctttaaaaggtggacacgctaaactaagcacttttctggataaatttaatactcaggaaaatagaagagatttagaaaatccacaaaaagaggtccatgctaccaccaccaggtccacattgtaatttaaagaaatcaagagagacatccttttatgtcaaactatcaatttcttaactatttgagtgtttacttacatggtttgtacagttgcttcttcttatttctacaactaagaataaaaaaaaaaaaactggtcacttctgatacaaataccataaaataaaagtagttgttaacatcttactgattactcctatgaaaaatgagacaaaattccattaaaaaaaaaattttcaataacatataatttaaattatctggcatgattaatttcataagtcaaatctaaaaacttagattttcatttagtttactttttgtttctattacacacaaatgaaagaatcctcatgtacaaaagaaaagggcaaaaaaattaggccagatgaaaaatttagctaataaaaagtttaactgttgcatatatgagccatgatccattagtattctctcattctgcatttacacatagcttactttaattatcagactctaagagctaacagttctaaaaactacttcctgaccagacacctatctctagatgcaacagaatccctgtaagcatcttgaaccacacttagtggttatctactaatatgtcactaaaaacaaaacaaaattaaaaaatggtctttacacaactggaaagtaacctatcttaaatttgttttcttttttgagatggagtctcactctgtcacctaggctcgagtgcagtggcgggatctcagcgcactgcaacctctgcctcccaggttcaagcaattcttcagccttagcctccggactagctgggaccacaggcacgtgccaccatgcctagctaattgttttttgtatttttagtagagacagagttacactgtgttagccaggatggtcttgatctcctaacctcgtgatccacccacctcaacctcccaaagagttgggattacaggtgtaagccacagagcctggcctaaattttgatgttaaaataagtatacaaacctaattggacatggtgtctgcagcacaaaaaatcattttttttccctaaaaagaggccagaataataaaagccccaagagggacttgggccatgctttgtttcctacactgcctctgcctttgatgctgggagggccttgtaggcaaaagttactaccactgaagagtgagggacatggaatagcttttcttttactgcttccatgctctctaggtgtgagaagcccatgcctctggaaggaactgggaaatacaattctgatatgttttggatatgttgcccctccaagtctcatgttaacatgtgacccttaatgttggagacagggcctagtgggaggcgtttgggtaatggcagtggattccttatgaatggcttggtcccatccccatggtaataagcacattctcattatggtaatttaaaagactgtggtactggccaggtgcggtggctgaagcctgtaatcccagcactttgggaggctgaagcgggtagatcacttgaggtcaggagtttcagaccagtctggctaacatggtgaaaccctgtctctaccaaaaatacagaaattagccaggtgttatggtgcccacctatagtcccaactactcgggaggctgaggcaggagaattgcttgaacctgggagatggaggttgtagtgagccaagatcgtgccattgcactccagcctgggcaacagagtgagactccatttcaaaaaaaaaaaaaaagagtgtggtaccttcccccttcccctctctcctccctctttcacggtgtggaaccacctgcttcccctttgccttttatcatgattgtaagtttgctgaggccctcaccagaagcagatgttaaagccatgtttgtacagcctgaaaatctttgagccaattaaacctctttttgttataaattacccagccttaggtatctctttatagtaatgtaaaaaatgaagacaaattctaaccagaaataactgactcaagatgggcaaagtctactcaaactataaaaacaaaggttacaaactcccgtgttttactgtgctgcattacttcgcacattataatagaaccctcacttgtgttcttgctgtttaagtcaactggaaaacttggctgtgtatggcttgttggcaaataaatgaggatttaatataacattaagggaaataagcaggagtaaggcatgtttaaatttacattatatcaaatgaaaaagttaataacctaaaacttttgagtagcgtaaacttggatgtggtaaatgaatgtggtcagaggactgtgtaagaggaggcccaaatcacagattcaatccctgatgataaacgactatgttttttaatttgtttaaatgaaaaccaagctgaagttctatcattcatctttaaaatgtactttttggagcaagggaaaagggattgtaaataaagatgaatccattaattataaataaagataaatccaagaattataaagagaaatccatgactcctccatcacatcacaaattaattgtgttgataaaaagatggcaaaatgtataaacaaaaaggttacacgttttcactaacatcataacaactaaaggaaagtatatcacatattaaaataagacaagggaacatgtgaaaagatgaaaattttaaaccaatatgagtttttctaaatactttctataacctgatcaaacaagagcttttattctttctcttggtggaaaaaacaatgtcgtctcaccatctgtttgagagttcctctggaatattgtgcttgcctctggattggcagaagggttaaactccaaagctatatgcatagaggaagaaaagaaaaaaagatgtaatcattgataaaaatttatcaactcgtttattcgactgctgcatttaggctatttcactatctctactttgattcttatccattgaaatgaatgtatagacataagagagagccaggcaagatggcacatgcttgtagtcccagctactcaggaggctgagatgggaaaatcacttgaacccaggtcaggaagttgaggccagcatgagtaacataatgacaccctcctttatttaaaaaaaaaaaaaaaaagaagaggtaaattttggctttgagttgtgtaaaatcaactttgcataaaataaatcaagatggcagtaagttttaaaagacaggtctattttataggcaaaatataagatgtattctagagtttttaaaatttttaaaaagtaaattcatcatatctgtcacttccatttcattctgaggacacagaaccttagttctcttgagtagctgtcttccatagtcatgtgatatctctaagttttcatttcttcgttagcaacacatagggagaacatacacaggccttatttgtattggaaagggccaagtgagacatacataaactgtgttgtaatcctaaagaatgacaataaagagccatttttgggctctcatccaacactacccatctactaactggtgtgtaacatccatcaggctttccgaacatcaccaagcagagtataagtttacacaagtacttacatgctttgtgtataaaggtacaatcaattaattcacataatacatttgtttattctaaagcaatccttaaatatcttgaaatgtgaagatagtacttccaagttacaaagtcacactcataatgagtcttaattatcctacctctttaaaaattaagagcgcaaccaaagtttaaatagaagagctataagacatttcctctacagtgatgaaatctctggcatttaaatgaaaacaataagcctactggatgtaatatgtttatgatgcaatgttttctattttgaaaatttcagtttttattcaagaaccatattattacccagaattacttttacttagattcatctctttgcaaaattttagaggcaaacgaactaattgttttctcttttctaccggctcccatcccctgcctctgccagcagtgtagagactaaaaaactccaactttctttcctttttttttttgtgagacggagtctcgctctgtcacccaggctggagtgcattggcgtgatctctgctcactgcaacctccacctcccaggtccaagcaattctcctgcctcagccttgtgagtagctggaactacagtcatgtgccactacgcccagctaatttttgtattttttttttagtagagacagcgtttcaccatgttggccaggctggtctggaactcctgacctcaggtgatccgcctgccacggcctcccaaagtgctgggattacaggcgtgagccaccaagcccagccaaaactgtaactttcttatctttgaacaagatgctattgtcaggaggggaagggacaaagggggagccatggcaacaaacactcttacagggaaggtctgacattttaacctgcaatctttatattacacattgaaagtctacattgacgtttcatgtcttttgaaagttttgaccatgaaccaatccccacctctcttttagaacaaggaggtaaataaagtctgttaagtcaccagaataaatctggagacacattttctgttaaagtaagaactttaacagaaaagagcttcataggtaaactcctttgagaaaccccaaacacacacacacaaccatttttctgcagccccggctgtgacatttcacacctttcacaattattttaagcactctccttttttctttttccttctgtgttcaaattacagttagaagaaactaagcagcttctatcaaggtgacttaaagcagcccattaagaataccatatagcctctcccatggcaaactccattctgattttaaataagaaatccccaaatatttgaataggaactgtcttgagatttggctactttaacaaaggaaacaattaggcacttacctggttccttcacttaggtaccatctggataggtacaaagaaaaaataagatgggtactgaaaagttgggatatttgagtttttattgagaaaaggaagagaatagctcaaagaagcctaaacaaagtcccacaggataataaacagagctacagacactgttgtctcaccatctgtttgagagttcctctggaatattgtgcttgcctctggattggcagaaaggttaaactccaaagctatatgtatagagggagaaaagaaaaaagatgtaatcatttataaaaatttatcaactcatttattcaactgctgcttattcgacaagagccataaataaatggtcccatgccagcctgggagaatgagatgagagagcaagaactgggcgattgggaggggaggcgaaaagaaactgactggactcggtggggaaatactaaggggtgggaattcaaggcagagccagcttttgttcctggccagctcccgggaaagctggctacaagcagaaaggagctcgaagtgggggatgcctcaaagggaaccttggggacagtagcagccagaggcaaaccgagggtagatggcacctatcacctcctcaccttcaggcatctcccggtcacgaacgtggtgcatgtggaggtcctcaccaacttcaacagtcacctcagcaggctgtacagcagcagccatgggcgctcctgccatcctgtccccagctcctgcctcatagatctcagattcagagggacacaccgacccctgctgctggtcaaactcgaggctgacgctagggtgcacacgacaggtcagtatgttccccatggggcgcctctactgtctgccaccacctgtgcctctgctcacagctttggccacgcactcccgctgtcctaggccgaggctatgctgcacttgcagagatggtcttcccgctcctcgcctgcccacctcacagcgcggccccgggcaccagccctggccctggccctggccccggccccggctagggctgcgggccaaggcccgcaccctgctgcctcccctgagttgacttgtctgggagggtgaagaccagccggcttatttaataggttgtgaacccaacaagtgctgagagacacaacaactgcctgaagagagaacagacggagctcctcctccttctgtagtcacctacagactgaagcccactggccccaggtgggagcccaggcatgtggcacacaatgccccaccccacacttcacaatgccctccccgacacctcacagtgccccaccctgcctgccacccctccccaacagctcagaatgcccctgccttggctgccccaccctgtggcttatgatgctgctgctctcctggcccctcgtgcagtgccattgggactaaggttttcattcatcaccagcttcctgagattttagtcctaagaaaagcaaagggtagttcattacttgaagccatcttcctctatgagttctatacaaagcctcagtagagtgggtccaattagcaaccaagttgaacaacttttatttgctgactaaatatagatacacctgaattgttgactgcttttgtaactaaacactcctctcctgtcttccaacgagtggtcatttttgtccgcaacttgaccacagcaatccctggggccctagctctactctcaataaagagttatggctgtgtgttttgaatgacaccttaggacccatcctgcctccacctccttctccataaaatagaaacctaacttgcccctccaagctctgaaatgctgaaacttaccaactcccttttctccccgctatttcttccttccgtggcagggactttcaggttttctttcttttactaacaaggcactaagcatgattttctcatacaaaatcgagagccataaagtggcttaccacagtcctatttcaataaagatgaatactcgacatctggcaagtagtgtgtgcctgacagtgtccccactgtgctatgctcatttaaccctcagaaacaatctcatgttacagattttgcagaagttgttgagacggagaaggtaagcaacctccccaaggtcacatgactgctaagggtggggccatagtttgatcccagctagtctgaattccccagttgcttaagcatgattatcagaaagtatagcagtctgttttcacactgatataaagaaatacctcaggttgggtaatttttaaaggaaagaggtttaactgactcagtttcacatggctggggaggcctcaggaaacttagaatcatggcagagggggaagtccttcaggaaacttacaatcatggcagaagggcaggtccgacttccatggtggccgcacagagagtgggaacatgtgaaggagcaactgtcaaacatgtataaaaccatcagatctcagctgggcacggtggctcacacttgtaaccctagtactttgggaggccaaggcaggtggatcaactgaggtcaggagtttgagaccagcctagctaatgtagtgaaatcctgtctctactaaaaatacaaaaattagctgggtgtggttgtgcatgcctgtaatcccagctactcaggaggctgaggcaggagaatcactggaactcaagaggcagagactgcagtgagccaagatcgtgccatggcactcctgcctggacaacagagcaagactccatcccaaaaaacaaaacaaaacaaaaccctataagatctcatgaggacttactgaatatcacaagaacagcatgaggataactgcccccgtgatccaatcacctccccctaggcccctccctcgacacatcaggattatggggattataattcatgatgagatttgggtgggggcatggcaaaaccatatcagaaagtaaaggtagaagtcaagcttggatgggaaatgacattgtagatgatgatgatgatgattattattattattattattattattttgagatgaagttttgctcttgttgcccagtgaaattgtttctctaatttcattttcagattgtgtcttgtagatgtatagaaatacaattgataaatgattctggctattaaccttttatgcttcaaccttgctgaacactattttttttttttttgagacggagtttctctcttgttgcccaggcaggagtgcaatggcatgatcttggctcactgcaacctccgcctcctgggctcaagcgattctcctgcctcagcctcccaagtagttgggattgcaggcatgcgccaccatgcccagctaattttgtatttttagtagagacggggtttctgcacgttggtcaggcccgcctcagcctcccaaagtgctaggactacaggcatgagccaccgtgcccagccagattcgtatatttttaaaagaattttttttttattttttttgagacagagtctcactctgttgcccaggcagtggcacaatcgttgctcactgcaacctccacctcctgggtccaggtgattctcattcaagtgcctaagcctcccaagtagctgggattacaggagcccaaccccatgctcagctaatgtttgtattttagtagagatggggtttcaccatgttgctcaggttgatctcgaactcctgacctcaggtgatccacctgccttggcctcccaaagtgctgggattgcaggcgtgagccaccactcccgaacagaacaacatttttttgatgtggattttaaaatgcctccccttctttcaacattgattaagtcccttctacatgccaggcactgtatgtgtgaaatagtcccaactctcaatgagtgtaggcagatacacaaacaaagccttaaggaggtcagttttctgagaccatactgctggacagtatatgaacctgggatacaaacccacctctatttgacctcaaatttgatgctggggtggttttaattttattctgggaatttcagtcattgaaccatgaaaaggtgaaaagtctctgtcagatgtgtgtgtagtggtctgtataataaggactgaaggaagcaaccaaacaaattaagagactttctctaaaggcagagtaatgctaagggcagtggcagtgacaaaagcggaggaaaaagtctgtgatcatttgggagacagaataggaagtgcttggtcatgagatgtgaaagaagaggggaagtagaaggaaaacagagctgctcaggctctgctggggaagactgggtatgtagcagtgccttcctcctggccaagaatgtaggaagagaaataggtaaggaggaaaagacagttttttactctcagtgtcacattaaaatggaactctctggtcaaaagttgaatataaatctctgtaggctaagtccatttgtgacatcccaacatatgttttcaaaaataacatacatactaaatcaagccattaagcgtaactggggaaatttcctaaaatttacatgctaaaaaatcaccatttttcatttattagtttcatggagcaactttgaatctatggttacagcaattgaggcaccttgtataaaataaagctaatacatgaaaaaaaaaagccatttaaaattctgttgttctcagagaatggagaaagcaattgaagccatgggtgtggaggtgactgccctgagaagctgtgtatagtaaggagaactgggaagaaagaagacctggagaatagggtgatttgcacggcattaagtgaagcttgcaaaagtgagcactgagactcaagagacctgcatatgaatcaggaatggctgctcctgtgagttgttagaaaggagatgatgccttcttttcatatctataacagcagcacctagcacagtgcctgttcaataggtactcaacatgtattatcccaatgcagagtcaaattttgccaggagggcaggaaagccacaaattagctatggcaacttagtgattgggcttgtgtgtgtgtgtgtgagcgagctggatgtcaggcagtgggtaaagtagtgaactggaggtgagaaaacaatgacacaaactcagggcttctcttcccaagtatttggctgagaagagagatgtagtattaaagggagatatgtggtaaaggaagacttttattccaagattcaacaaaagcgtgagtatacttctatgttaaagggaaagagccaacagagaaaacacatttttgaggttagaagagaaggaagaactaatgcagaagggccccaaaaggcacaggtgcctgcaatctggatcagggacagattagctttggactcctacaaaagcaagaagggagaaaggaccatgtgactctagagatatttctggtaaaggaaaggtttaggaaaagatcttttgatgacctttattttaacagactttttttttctttttgagatggagtcttgctctgtcacccaggctggagtgcagtggcacgatctcggctcactgcaacctctgcctcctgggttcatgccattctcctgcctcagcctcctgattagctgggactacaggcacccgttaccatgtccagctaattttttgtatttttagtagagacggggtttcaacgtgttaggcaggatggtctccgtctcttgacttcgtgatctgcccgcctcggcctcccacagtctgggattacaggcgtgagccactgcacccggccagactttaaaaaaaaaaaaaaaaaaaaaaaaaactactgtgggaaaaaggatattatgtatagaaaagtctacacttcttgatacaactaactaaaaaaagcctgatacactaaacaaaacccaaataatgtcttccctaaaagtgggtaacttgaaaagcaatttgagcaaaaatcaaggagttcaattataaataagtatatcaacaaagtgaaagatgggtttaatttttcccacaaaaagttaaaagaaataacagcaggtttagaggaagaggaaaaaataataagaaaattatatgcagttgcaaaatgtgtgactatttacaaactctaacatataactacaaaatggaccagaagaatcattatcataggaagcaaagggtcatttcaaaaatcagaggagggatgattcatatttaatttaattctgtggaaaaaatttaagtaatgtttgaggacaaaaataggtgatgtgttgaaatgcgggaaaccacagtggaaggaaaaataattcaagaaagctcagtttcagtaaccagtatctagtaaaatcttcaggacctagaggctacaatctgcattaatagtgtctgaagacctagaaatgtcattaaataccattttggataattcttgtagacttgagatgatgtctatttaaagttacaaaatagtgcccatatttctgtattcattacagaaaacaattggatatggaaaagaaactaacatgctatgccacaatctctaaagaaagattagggaagtttcagcttaaagcaagaataatcacaataaagttttacaaccctttgcaagcatatatgaaaaacttacaaaaagtctgtaatgatcttttcttaagctaagagaacagaaaaaatgagaaaaattaaattataaaatgaaactttggtttagaggtaagaaacatttgatgacagtcaagagatcagggttgtacagtgtattatgtgaatgttgtgactcattggtttcatcttggatatcataacttgacattttgtaaaagtgatttttcatgggagtttcttcaggtgccctatgaagtcctgtccctttagaagcgaataatagtcttccacattcttgagatatcttaatgaataacatcttctacagtcttccattgtttagaccttggagagacacgcattagtgactgttaaggtacctgggttattaggtgcctgtagactatgcccagtgatatgtgcattaggtacatgctccctagctgtgctgacactgactgaagctgtgaggtttcacaatgacatgtcagccaaatacatatgctcagatttaccatttatcaagaggtcttcacactatcaattgtgcaattatcattctacacacaggcagcgataaagggagtaaaaaaacacagccatggatcgggagaccaaggtacctccagaggagtccagtgggtccagaagccctttggatgttggtcagaagctcctcttgggcagagatcacagcagcagccaacaggtctggagaagaccttacagttctcatggacaaagtttgtgaaggcatcttagacaagatcttgtctttgctggttttatgatcctctgcagatgggtctattctcattacctcagccacctttcacttcctatcagttcagttcaggtctctcatgatcccaggcagcagtagttgttatcacgtaagttcattcatatatgtttatctctggggatggggggacaacttcactgtggacttaattctactggagatgagtgaccccattttaagacaacaggatcacaaattattatcacatatcagcagggcagacaatagctacgacctggggctgaaagcaggtaactctatttattctgcaaaaattctgtcttgattatggtgccagttgctgtgagggatttcctttctagaacctgtttttcacaaggtttgagtctgaactgttaacattctactgatttctgggtgaagggactgactgcaccatcctagcctgtcagagcacttgccccaatacttccactttaagagttttccaccttgtccagaactacagtccactaatcccctcattttctctcttaagagaataaacaggccaggtgcggtggctcacgcctgtaatcccagcactttgggaggctgaggcgggtggatcatctgaggtcaggagttcgagaccaacttcgcctacgtagtaaaacctcgtctctactaaaaaaaaaatcacaaaaattagccgggcgtggtggcaggcacctgtaatcccagctactcgggaggctgaggcaggagaatcccttgaacctgggaggcagaggttgcagtgagccaagactgtgccacagaactccagcatgggcgacagagtgagactccctctcaaaaaaaaaaaaaaaaaaaaaaaaagagagaaaaagagagagacagagaataaacaacccatgtcaagtacacacccacatccctcttatcccaaataccaaacacacaaaaatccaatctgtctccttctacctaagcaattgcagatagtcacattcccataattaccttaagctccctgacttgctgctcgtcctttctctggcaaaatctcatccttggatgagcccgactttgtgtttgctcaatgacaccactcacctgaaccagaaaaaatatcaaaaagtggtcagagatatcatcataaattcaaattacttacataaaaaattggccctaaatgtttccagaaatcaataaaagttttgtttctccaaagacatcatttcttcagaaacccaacgtgtataacctattttttctatgttcttctaacattcattcaacttctctcatctgatatcttgccaaatcattcaaagagaaaatatatcccattagtcaagagccaaccatattcccatcacctgagaaaatcatatgcacaggatgcgcccacctcacctttctctgcctcatgtcagaaaaagtacccctccttttgtcacaaggcaaacctgagataaaagatttagatggcctgtaattccagcactaagggaggccaatgcatgcagattatttgagtctaaaaaagaagcctaagcaacttagggaaactgcatctctcaaacaaatacaaaccattagcctagcatggtggtgtggtggcacatgcctgtagtcccagctactcagggtggggagcactgaggtgggaggatcacctgagctggaaggttgtggctgcagtgagccgtgatcacgtcactgcactccagccagggtaacagatattttttaaaggatcttctctgttaaaaataatcaaataaacaggtggccatgaggctgaggtggctgcagtgcactcaattcctccttaaataacccaaaacttgactcagtgtaaataataaaaggaaacttaagtttaaccagtcagaaaccaccaactaacatctaactagagaccttccactgtaatgttccaaatgaggccactgctccacttcacccaatcaagtattttctttttcttccacattcaccatataaaattcttcccccaccctccctaagcctctctgtgggacctctgagctgcttgcagtctggggctgcctagtttatacatttctgaatgctcaaatatattttctaatgtttcaaagtggctctggtgtaggaggttgttggtggagtgacccgagagtatacaggaattgaggccatatgagatctctggaccctgtactccattttgctgtacactcaatactactctaaaataataatatatctttaaaaatctataactatcacgtagcccttttcaagtctccaactggttggagccagttcgattaaagctcagaaaaaactggttaataagctagttctgacccaactggcaagaagcggcaggaaagacccaggccaggggagcatattgcacatgcatgcaccaggaaactggaggaagcttggaggccctttagcctggtcctgagcccgctgaaactgcagttacaggcacagatgcctggggcaccaatctgaatctgccaacatccaaggccacatgaacacaaatgcacagtctcctctgcgatcggtagctaaggatgttaggccatgattggactaggatgggagatgaactgagaactctggattctgtaggttgttgttgtctcttcccacccccaagcaacaagtgatgaacacacacacacacacacacacacacacacacacacacacatcccgtagtgactaacaggatctccctccaggggatttgcaggaaggggagcagaaaacatcccaggggcctttcacagctacttccttgagccccctttcagacagtgctgtctagacctgtctcagcccaagcatcaccaccctgatacgcagaagctggcatccttacctgaaattcaacatcaagaaatgatctcttctactcaacactgatagaaatacctctaagcaacgtcctcattggcaggggtggagtgggggagtttcttaaaaagtgaggcctctgcctaccacctagagaacctggaaatttccatctgtgccacaaagtccaaatcactggccactgccccagtgtatggcagattagaacatctctccattggatctgggtttctattccattgagtgaaatgccttttctactacaggaacagaataagggatcaaaagggtcttacaactgaactccagtgtacagtctgcacagacactaggcttgtgcaaatatgacacagcgaggccccaggacccttaagccagctgaatgtactgagtttcaggaaacagtgagatacattcagcaaaacagtgggcttcatgctgaaagaagtcaatccaagtaaacacacatctcacacacacacacacacacacacacacacgcacgcacgcacgcagacaccctagtggccaataggtcctctcaccaaaaacctgcgatcaggagagcagaaagcctcccagggctccaccactgccctttctgtagccccttatcagacggccagcctcaggacagcactgtctgatcctggtccagcccaaaccgccatcaccctgtgatgtgggagcaggccacttcaccagaacctctgtggcagaaaaatttctttcttttaaaatgatgagggggaaccttcagacagtgtcctgattagggtgggtggagaggggggtttcccagaaagtcaggcagggcagggcagaagccctctgggttaactgtgtgcttttgatatgaaggcaggtaagactggacaggtgggggtgttagtgaggggatggtgtagggtgctgaagaactccacttgggctctgcgcaccagggaaaatgaccacaaaacatcccatcttcactgctcagagaaggctagatctgctgtgagctaggaagccatgtgggggcagctgatgagtcatcaaatgggagaaatctgagagccatgtgttccacaggcctctggtccttgttcaggcagcagggcactgtgagatgtggctccttggccctttccagccaccaccttgattgcctgctgcaaggaaagagactgaagcccaagaatggggtcttgctcaccataggatgatggctcagtgtgcagagctgagctatggcccaagaggcaaaaggtggggatgacccaggctgagctgggggatccaactgaacatgcacttgctaagaagctgtgggctatgatgccttgggaccccagtctgggtcgagaattgtagcaaaacaggctactggtaaaagttcttgggaagccaactcacttttgctttcatccgtgggcaaacaaacctctgatcaaccacaccacaatggtgtcactctgtaaggcacaggcagacaaggcatccagccttgcacactccagggcccacacatgtccagaatacaatggttcttgttgagactccactcttccaactcagacagaagctccccaatctcctcagccactcccaacaactggaggtctgaaaactttcatgcatgccgctatggtctaaaccactcgtggtggttttgattttcattttcctgataatcagtgatgctgagcacctttccatatgccttttcaccaactggatatcttctgtggctaaatgtctattgaaatccattgcccatttacaaatctgcttttttgtgggcttcttgatgtttttctttttttttttcctatttatttatacaagttccttagatattttggatatttttaaaaatgattttcaattccattgcccagttataaatcttttttttttttttttttttttttgagacagagttttgctgttgttgtccaggctagagtgcaatggtgcaatcttggttcacagcaacctccacctcccaaagtcaagcaattctcctgcctcagcctcctgagtagctgggattacaggcatgtgccaccatgcccggctaatttttgcatttttagtagaggcagggtttctccatgttggtcaggctggtcttgaactcccggtctcaggtgatctgtccaccttggcctcccaaagtgctgggattacaggcatgagccactgtgcccggccaattatccctttttgtggtttttttttggggggggtggggggaagaacagagtctcgctctgtcacccagtctggagtgcactggtgtgatctcggctcactgcagcctccgcctcccagattccagcaattctcctgactcagtttcccgggtagctaagattacgggcgcgcaacacatgcccagctaatttttgtatttttagtagagacggggtttcaccatgttggccaggctggtctcaaactcctgacctcaggtgatccacccacctcccaaagtgttgggattacaggcgggagccaccactcccggccccattttgtgttttaacatcagtcgacactcgtattttaaaataataacaatgaatggcggtaccttagaacaaggtaattatacatctttctcttgtcctagtgcagacattttgtctataaaatgttattcacagatgaattcatgaaaacattactgtgaattttaaatccatatacaagtgtatgcttgttcatgaatacttcaataaaataaaactaatagcaaaaaagaattccagagttgaagcagtttcaggaaaaaggagttggcagtatgaagtaaaatagaaaaaaatgggtttttttttaaatgggtatatttgtgtctacaacttttttttaattatagcattagacaatgtgtatatatatatacatatataaagcaatggaagtggcattgttttcatactagtctaggatattaaaatatatgtaatatgtgattggcaaaataatggccccccaaagatgtccacagattcctagaaccttacatgaaaacggtacatcatgcatgtgattcaggtaaagaccttgacatgaggagactaccctggtgctatggaatgaacgttgtgttccgtcaatgttcatgtgttaaaatcctaaccctcaaggtgatggtattaggaggttaagccttacgggagactctgccctcatgactgggattagcaccttattacaggcacaagggagcttgtttgttcctctcaccatgcgaagacacagcaagaaggaagcctctatgagaaagcaggccttcaccagacaccaagactgccggcaccttgatcttgcatttctcagcctccaggactgtgagaaacgaagttctgttatttataagctacctggtctaatgcatttccttgtagcagcctgtatggattaggacagtgggctcatgtggatgatgacggtgtgtccattcaggactaagtaagcacatgagtccttaacagtggaagagaagggggaaggaaagagccacagagacatgtggccacagaagaagggtccatgggatgcaaggttgctaatggtgagagtggagaagagcccaaagccaaaaaatgcaggcagactccagaatgtggaaaaggcgagaaaaaagatcccctagagcctctagagatgaaggtagcctttccaccacctagattttagcccagtgagatccacatcatactctgacatacaggagtgtaataaatttgttttatgccctgacatagtggtagtttgttgtagcagcaatggactagtaatatataaatatatatatacacacacacacacaaacactacccccccaccacacacacacacacacacacacacacacacacacacacacacacataactatatatatcctacccttcaaaattgaagcagataaactacacattagcattaacttagctgggtgtagtggatcatgcctgtagtcccagctactcaggaggctgagagggaggatcatgtgagcccaggagtttaagatcagcctgggcaaacacactgaggccacatttcaaaaacaaacaaacaaacaaaacacaacaaatctttgattaagctcatttcccaaatttgaagaggagacaattattagataaagaggagaaaagagaaaggtagagctgctgacttttgtggcggaagcagaggcacaggcccaaacatactcctttcctcctggctttcctgtcccttctcataagggacacatgaacctctcaaactgaaccatggatcacagacccatactcagaactcaatacagttttgttctatgattttttacatgtctgtgtccttgcttctgcctcccattcccaactcccttactctagttagaaaaaaatggctattaccaaatatgagtacatcctcatatactaatgccaactgatcatcacctggttttcttcttttacaaagtcataaatctttagactttaacacatcttccaagcaatagaatgttattttccagtccattaacacaaattctatatttaaaatgaagacttcacaagttgatttaaataacatattaaccaacatagactggccatggttcaaactgacattttaattaaatgtgatgataggttgagtaacctagcagtactctaaaatgacttttggttatggctttttccatattatgtttaggctgaggcatccctaaatgattcaactgtaattcctcttcttaaacatgagatttatctttacaaaataatttattttcttaaaattacaagttaattctatagttcatgcatacataatctcagcagatatcagctgtatgtgtacacacatacatataggtatttgtatatacacacattacataatttttttaaaaacttattagtagggtagaaccacgaagacaaagaggctttgtgtaatgtgatggaaacacatttgcaggacgaacaacaggctgctgtgagggctgcatttaccctttctactgtaagacttggaaaaacatggatagtggatatttaatccgcataacagaaatttcagggtgcagaaaacttcccacaatttttacagacaatgtcaacagacaggcattcaatgcagggaatacacagtgtgacagtatacaaaaataagcaggttgatggtttagatttatgagacaagagaaagaaatagatgatgccataattctccttttatggagttatgaaaattgttcattttatataaggtcaggtgctttcaaatgtcaatgagaaaaatatttaaaggaagaatcaaatctaagacgtggagagatctttataaaaatgaccttcaggccaggcacggtggctcacacctgtaatcccaacactttgggaggccaaggtgggtggatcacaaggtcgggggatcgagaccatcctggccaacatggtaaaaccccgtctctactaaaacacaaaaaattagccgggagtggtggtgtgtgcctgtagtcccagctacttgggaggctgaggcaggagaactgcttgaacccgggaggcagaggttgcagtgagctgagagcaccactgcactccagcctggcaacagagcaagactccatctcaaaaaaaaaagaaaagaaaaaaaattaccttcattctgagaaggtataatcatcaacacattcttgagcaaaactacgcacatacacacttccaaattcacaaaccatgcttgtgcacacactgatgtctctagattccttttttgaagagatggcaacttggtgtgtcacccaggctggagagcagtgttaggatcatagctcactgcagcctcaaactactggggtcacgtgatcctcctacatcaggctcctcagtagcctgaactataggaatgagccactatgcccagccaatgttttcatttttttgtagagatgaaatcttgctatattgcccaggctggtcttgaactcctggccccaaggaatcctcctgccttgccctccaaacgtgctgagattacaggtgtgaaccattgtgcccagcaactgtattctttattaagaagaaaatttgtttgctgacatgtaggcaatgaattgataagtaatagttcagaaattactaatttacaagtcaatataaatgaggtgagtaaacacaaaaataacagcataaataaacagttcatgacttcacgtttctttttctcctttaaaatgtagctctgacagagactactacttgtccattccatggaaaagtcagaggtggttaaaatgtcagaggtacacttactaatactttgatgccttttgtgtagcttcttctcagtacttcaccagctgggattgacacacctctacaggtgggttcaggagccagacagcagcacacagaatggggaatccaaagccatctctgacactaaaagcaatgaaaacaaaaataaccaaacatattatcaagaaatgaacaagagattgatatcaagtaaagcaagaagagaagaaagcatttaatctgccaggctttcattctgacaaaataatttacaacatgcatgtctctatctgacatgagtgaatagaaaaagaacccaaatacccagttgaattgcaagatgaaaatgaaaaagaactcttgcttattcgccagggtacaatctaatctgggctactaaaacactttcatgcactgattctatgtaacacatgctttattgccatttggaaatgggatttcttgctttgatttaaatatacttccttggatttctgctttaagtatactttcttaaacatattcacagctacattctcagtacaaattttcaggtgtaagtaactacttctgcttttgatagtataattggtgaaataagctatacttccatgtaaatgtgagagtacaaggtaagattccagagtcaagtaaaacataacagtcaagaaaataaaaaggtgagagtaactgggcagtggggaaatcttgtgtgtggaaagaatgaatctgtaaaactgttctttcctaagagagttcagcaggatttggatgatagagagctttgtgtacaagggttccagttccacatagtttaggtctaatttcaaaggcaacttctagtgcaacctgtgactcacgctgtcctaaagtgccaaatgtaaagggtctggagataacccacaagcagcactgtgaacccctgacagcaagcctttccagataaatacctgtcagtgtctatagctgatgacagagcagaatatctgaaaaataatacttcttcggccaatggactgccagtcactattatttagtgtaaaatactatattacatatgtgtaattttttaaattgcagtgtttcacatcgaagcaactaaatataaaaaccaaatgtttattcagcttaaaggcaacttagaaatactgatcccagatagaaagatgctttagtcccaagtcagctgttctaaaatgccacaactaaaccaacgaagggatcttgaagcatagtaagtgttcataccttttcagctatacctctgcttgtcttgaatataaaaacctaagctgcagttatgccacagcacagaatgtgttatattttacatcactgagccttagttttacaaatggtaaaaaaatagggaaggtaaactgaggttttcttaaggagctgttacatccaagagactcgtgaaaatctttgccaaatgtccccggtacatagctcctccccactgatgggctcaacggggagaagctatgcacatgtctcaatctgcatatgctcaatggcaatacaggattcctaggataaagtaagggatataaatgacacagcacactgaaaagactgtaatgttacttcagaatgttgcaaaataaagattacagatgaaagttttagttcactgaagcatgtagtcatgtatatttcatttgtgtgttttaaagtcttatactgcttacattctctttttttgtttgttttaaaataattatatttggctacaaagatcaataacaaggatgatgtcagtccaggttggacaggcagttctggggcagatgttcttgcagtatttttttttttttttttttttttttagtatttattgatcattcttgggtgtttcttggagaaggggatttggcagggtcataggacaatagtggagggaaggtcagcagataaacatgtgaacaagggtctctggttttcctaggcagaggaccctgcggccttccgcagtttttgtgtccctgggtacttgagattagggagcggtgatgactctcaaggagcaggctgccttcaagcatctgtttaacaaagcacatcttgcacgctcttaatccatttaaccctgagtggacacagcacatgtttcagagagcaccgggttgggggtaaggtcatagatcaacagcatcccaaggcagaagaatttttcttagtacagaaagaaatggagtctcctatgtctacttccctccacacagacacagcaacaatccgatttctctatcttttccccacatttcccccttttctattcaacaaaaccgccatcgtcatcatggcccattctcaatgagctgttgggtacacctcccagacggggtggcggccgggcagaggggctcctcacttcccagaaggggtggctgggcagaggcgccccccaccgcccagacggggcggcagccgggcggaggcgccccccacctccctcccggacggggtggctggcggggcaggggctgccccccacctccctcccggacggggcagctggccaggcgggggctgcccccccacctcccggacggggcggctgtcttgcggagacgctcctcacttcctggacggggcggctgccgggcggaggggctcctcacttctcagagggggcagctgctgggcggcggggctcctcacttctcagacagggcagctgccgggcggaggggctcctcacttctcaagacacggcggctgggcagagacgctcctcacctcccagacggggtcgcggccaggcagaggcgctcctcacatcccagacggggcggcggggcagaggtgctcccctcacctcagacgatgggtggccgggccaagacgctcctcacttcctagacgggatggcagccgggaaaaggcgctcctcacttcccagactgggcagcccgggcagaggggctcctcacatcccagacgatgggcggccaggcagagacgctcctcacttcccagacggggtggcagccgggcagaggctgcaatctcggcactttgggaggccaaggcaggcggctgggaggtggaggttgtagctagccgagatcacgccactgcactccagcctgggcaacattgagcactgagtgaacgagactccatctgcaatcccggcacctcgggaggccgaggctggcagatcactcgcggttaggagctggagaccagcccggccaacacggcgaaaccccgtctccaccaaaaaaatacaaaaaccagtcaggcgtggcggcgcgcacctgcaatcgcaggcactcggcaggctgaggcaggagaatcaggcagggagggtgcagtgagccgagatggcagcagtacagtccagcttcggctcggcatcagagggagaccatggaaagagagggagagggagaccgtggggagagggagagggagaccgtggggagagggagagtgagagggagagccagaatttcctttttacaggcagaataatattctatgtatataccacatttttctttttttgagacagggtcacctaggctggagtgcagtggcatgatcacggctcactgcagccttgacctccccaagctcaagtgatcttcccacctcagcctcgggagtagcatgtaccaccatgcttagctcattttttgtatttttagtagctatgttgtccaggctagtctccaactcctgggctcaagcaatctgcccatttgcctgcattggcctcttagaatctatctttttttttttttttttttctcactctgtcgcccaggctagagtgcagtggcacaatgaaggcacactgcagctttgacctcctgggctcaggtgattctcccatctcagccttcccagtaagtgggactacaggtgcccaccaccaagactggctaattttttgtatagacagggtttcaccatattgcccttacactcctggactcaatctgcccacactggcttcccaaagtgctgggattatagacatgagctaccacacccagcctgtatggctgttgtgaataatatgctgttatgaacatgggcacactaaacaccattcaacttaaaaaaataatcaaagccttaagaactgaaccaaaatggcttaggtgaaaataaaataccaaactctgctctaagaaaaggaaagagcattcactgaattataccttcagcaataagcacttaatggaacttgtttcatttaaaatgcaccacaatcctgtaaattgataatcataccgcaattttatagatgagcaaggtattaggcggacctttttcaaaaggtcatacagctagtgacaaatatttccaaatttttcataacatttctttttttgagacggagtcttgctctgtggcccaggctggagtgcagtggtgcaatctcggctcactgcaagccttgcctcccaggttcacgccattctcctgtctcagcctccctagtagctgggactacaggcacccaccaccatgcccggataatgtttttgtattttcagtagagacggggtttcactgtgttagccaggatggtctcaatctcctgacattgtgatcctcccgccttggcctcccaaagtgctgggattacagacgtgagccactgtgccaggcctaacatttctgttttaaatagcttaattaactacacatgttctatattcttgcctctgaaaggcagctttttttgttgggttggtttattatgcatcagacacttgatttgctgaggaattctgtttttcagtaattcatccaccacaaatatcacgtagcattttgactccacagacctaagagtcttaagtcttaaaaggattgtaaaatctaagtttttctgagatatctgagagtaagaggcttttttctattgaaaataggttgcatttcaaactttatctgtaagagctcacaacactttctccaacatgcatgcccatgtgatcacttaaacagaactctgagtgagacagtaaatacctcatatgcccttgaaaattttaccttggcatagaaaaaccttgttaagaacctaaaaataatttcactttgaaagtctttagggttagacaaatgttaaacttcaattggcagtacaagggcagcactcaagccagcaagagttttgttgggccaaattatgttgaaaaagatcaaatattttaaaaacaggagatttcacataaaaatctgggattccagcttcttctgaataaatgaggtacactaattatgcagagtggcaaatggctggagttgagtgggaggtgtttctagcccaacagataggcatggaagctccagctcagccccctccactccattttcttacacaagggaagccactatggtatagcatctaacttaaggcatattatatgtattcttaagacagaggaaaaggctgaatatttgatattgtcaaaagaaatgagagtctaactttctgtggcaaggaccttcttgcagtagtcacataacatagtctggaacacctccaacataaattatgaaaagaaagctcttggctcagaagagaaaaagcaaaaaagaatactcattaattctatgtcacaggacaaatagatttcaatttccattgcaattgtagaagaggtaaataatctgctgacccagaattccaacagggactcacacttcctgtcttaataactcgaaacactgaaatcactctaacaaaggcaaatcaatgtcttattaatttctggttaaaaaatagacccaagaagacagggcacagacataaattttgtgtggtgggaatacgaatataacttcaacgtccagattcatggatttggaaatgaccttgggcactctaagtatagcaccactgaagtttacatttagggaatggctaatccctgctgatctaaactatttccaatccccaatgtactctttaaatacagaaatttaaaaaaagagggggccgggcgcggtggttcacacctgtaatcccaatacttgggaggccaaggcagggtggatcgcttgagctcaggagtttgagactagcctgggcaccatggtgaaaccccgtctctacaaaaaacacaaaaaaattagccaggcatggtggcgtgtgcctgtagtcctagcatcttgggaggctgagatgggagcatcacttgaacccaggaagcagaggtggcagtgagccatgatcacaccactgtactctagtctgagaccctgtcaaaaaaaaaggaagggctcaacatagtaggtacagagctattttaatagaaagatcatgagggaaaaactagcagctgtcagatagagagtaatttattttattcatttatttatttttatttttatttttttgagacagagtttcgctcagctgcccaggctggagtgcagtggcgcgatcttgcctcatggcaaccaccatctcctgggttcaagcgattctcctctctcagcctcccaagtagctgggattacaggcacccgctatcatgcccagctagtttttgtattttagtagagatggggtttcatcatgttggccaggctggtcttgaactcctgacctcaggtgatccacctgcctcggcctcccaaagtgctaggattacaggtgtgagccaccacacccagcatttcatatttcatttctttcatttcaagatggaaactcactctatcaccccggctggagtatgccactgcacctgacatttcattattcatttcatttcattatttcatttcttcatttcattgcacccagcatttcattattcatttcattatttcatttcttcatttagtttcatttcatttcgagatggaaactcgctcaatcgcccaggctggagtgcaccaccacacccggcatttcattattcatttacttcatttcatttcgagacaagagacttgctctattgcccaagctggagtgcgccaccgcacctggcatttcattattcatttcatcatttcattttatttcatttagagatgaagactcactctaccgcgcaagctggagtgcaccaccacacccagcatttcattattcatttcattatttcatttcatcatgtcatgtcatgtcatgtcatgccatgtcatttcatttcgagacagagactcgctctatcacccaggctggagtgcgccactgcatctggcatttcattattcatttatttcatttcatttcacccagcatttcattattcatttcatcatttcatttcatttcgtttcatttccagatgaagacttgctctattgcccaggctggagtgcgccaccgcacccggcatttcattattccattttatcatttagtttcatttatttcatttcatatttcatctcatttcatttcatttcgatggagactcgctccattacccaggctggagtgcgccaccacacccagcatttcattattcatttcatttcacccggcatttcgtatttcatttcatcatttcatttctcacttcatttcatttcatttgtttcatttcatttcgagacagagactcgctctatcgcccagtctggagtgcgccaccacacccagcatttcattattcatttcatttcacccggcatttcgtatttcatttcatcatttcatttctcacttcatttcatttcatttgtttcatttcatttcgagacagagactcgctctatcgcccagtctggagtgcaccaccacacccggcatttcattattatttcattttttcatttcatctatttcatttcatttttcaatttcatgacgtagactcgctctaacacccaggctggagtgcacccagcatttcattattcatttcatatttcatttcccatttcatttcatgacagagactcactctatcacccaggctggagtgcgccacccacatttcattattaatttcattatttcatttcatcatgtcatgtcatttcattctgagatggagactcgttctattgcccaggctggagtgcagtggtgtgatctctgctccccgcaacctctacctcctgggtacaagcgattctcctctctcagcctcccgagtagctgggattacaggcacccgctataatgcccggctactttttgtattttagtagagacagggtttcaccatgttggccaggctgatcttgaactcctgacctcaagtgatccgcccacctaggcctcccaaagtgctaggattacaagcgtgagccactgcacccagcatttcatattccatttcatatttatttcatcatttcatctccttcatttcatttcaaaacggagtctcactctatcacccaggctggagtgcatcaccacacccagcatttcattattcatttcatttcattatttcttcatttcatttcatttcacctggcatttcattattcattatttcatttcttcatttcatttcatcccatttgagatagagactcgctctatcacccaggctggagtgtgccactgcacctggcatttcattattcattgcattatttcatcatttcatttatttcattttttcatttcatttcatttcacccggcatttcattattcatttcattatttcatttcatcatttcatttcatttcattttgagacggagactccctctattgcccaggctggagtgcgccactgcacccagaatttcattattcatttcattatttcatttcatcatttcatttgatcatttcatttcatttcaagacagagactcgctctatcacccaggctggactgcgccaccacacctggcatttcattattcatttcacccagcatttcatatttcatctcatcatttctcatttcatttatttcatttcatttcaagacggagacgcgctctatcacccaggctggagtgcgccaccacacctggcatttcatatttcttcatttcatttattccattcccatattcccattcccattcaatttcaatccatttcatgacagagacttgctgcattgcccaggctggagtgcaccacacgcatttcattattcatttcattatttcatttcaccatgtcatgtcatgtcatgtcatgtcatttcgagccagaggcttgttctaacacccaggctggagtgcagtggcgcaatccctgctcactgcaacctctgcctcctgggttcaagcgattctcctctctcagcctcccaagtagctgggattacaggcacccgctatcatgcctggctagtttttgtattttagtagagatggggtttcatcatgttggccaggctggtcttgaactcctgacctcaggtgatccaccgtcctcagcctcccaaagtgctaggattacaggcgtgagccaccgcacccagtatttcgtatttcatttcatttcatatttaattttgtttcattatttcatcatttcatttcaagacggagtctcactctatcactcaagctggagtgcatcaccgcacccagaattttattattcatttcaatatttcatttatttcttcatttcatttcatttcatttcacccggcatttcattgttcattatttcatttcatcccatttcatctcatgtcatctcatttcatttcgagacggagacttgctctattgcccaggctggagtgcaccactgcacctggcatttcattattcatttcatcatttcatttcatttcacctggcaattcattattcattttattatttcatttcatttatttcatttattctcttcatttcattccatttcatttcgagacagagacttgctctattgcccaggctggagtgtgccaccacacccggcatttcattattcatttcatcatgttatgtcatgtcacgtcatttcattctgagacagactcgctctatcgcccaggctggaattcagtggcgcgatctctgctcactgcaacctgaggtcgggagttcgagatcagcctgaccaacatggagaaaccccgtctctactaaaaatacacaaaattagccgggcatcgtggtgcatgcctgtaattccagctactggggaggctgaggcaggagaatcgcttgaactcaggaggcagaggttgctgtgagccaagatcatgccattgtactccagtctggccaacgagagtgaaactctgtctcaaaaaaaaaaaaaaagtgatggtagatgctcacactggcaaacgttagcaagtactagaagggtcatttggcagtagtcattcacgttttaagcatgcagataatttgctcaaataacttaatttttagcaatttatcctacaactaaaatgtatgtgcaaaactgtatgtacgacagtgtttaagagaaggcctcaaagaaaaggtggtatctgaacaaagatggacagatgatgcagcatttgaggtaggtatctggaaggattgttctaggaaatggtaacagcaagaataaaggccctgaagtgggagttaaaagacaatgggaataggagtagaatctggagtcatcaaagtggcaagggagcaaattacagagaagatagagccactttaaagaatctggcttggcccggcctggtggttcacgcctgtaatcccagcactttgggaggctgaggtgggcagatcatgaggtcaggggatcgagaacatcctggccaacatggtgaaaccccgactctactaaaaatacaaaaattagctgggcgtggtggcgggcatctgtaatcccagctacttgggaagctgaggcaggagaatcgcttgaacccaggaggtggaggttgcagtgagccaagattgtgccactgcactgcagcctggcgacagagcaaaactccgtttaaaaaaaaaaaaaaaaaaaagcaaaaaaaaaagcttaattggattttgattgctaccttctaaatatcagcactttcatttaatcataagcctcaaagggtttataaaacttctaaagagttaagtttcataattctcctaacgagagtctacacatactgagatgttaatgcagggtttagaaactgtcaaaaactttcataagaccctcaaagagatctaggacaattcctcccacccacagaaaagcaatcacccaaacaactgagaatcagtggcaaaaaaactctcctaaaaggacacagtactatggggagtcaaaaacaattcagacagctgggcacagtggctcatgcctgtaatccagtaactcaggaggctgaggtgggaggattgcttgaggccagcctgggtaacatagcaagaccccattgctaaacaaaaaaagaaacaatgaaaaaaattagctgggtgtggtggcatgcacctgtagtctgaaccactgggcaggctgaggtgagaggatcctttgagcccaggagttcaaggctgtagtgagccatgatggcaccattgcactttagcctgggtgacagagcaagaccccaactcaaaaaaaaaaaaaaaaaaaaacaagggaaacattttagtgagtttagtcttgcctggaagagacaagtaagggacagatgggggcagtggtgagggagcccaggacagctagctgctatgctattcaaagtcacatatattgcttccacaatataacaaaacagagaaagaaaccaccaaacagcaaaccgtcttctagtgatcccatcatttttttttctttttttttttttttttttttttgagacagagtttcactcttattgcccaggctagagtgcagtggcgtgatcttgcctcaccgcaacctccacctcccaggttcaagcaattctcctgcctcagcctcccgagtagctgggatttcaggcatgtgccaccacacctggctaattttgtatttttagtggagaccggatttctctatgttggtcaggctggtctcgaactcctgacctcaggggatccacccgcctcagcctcccaaaaatgctgggattacaggcgtgagccaccgtgcccagctgacccaatcatctttcacttcaaccttttcctcaccatctcttcaactaatacttttcctggaccattttgactttaggcttctacctccaatctattttatctacccactacttctaacttaatcttcctcagagataattctaatactctgtccaaaaacctttgatgacatgctgcctttctatgtaattttaagcttcttaccttagctttccatgccataagcctaaactatcttcccagacttttctcccacaccttccttatatgtatcgtataatcaaacagatacatcagaaaattcagtccatccttaaggtctggctcaactgttatttattacttctttcccttttctagaaattttcctgatttctctgtcctggaggtaatttggtttggtgagaaagacaacgggctttggactcagactagagtttgatgcactagaacatgacagagctgtgtgagcatgtggaggtaatttaacttgtctgaattttagtttctttgtctataaaacaagggagtaccagtctactaccttcagagaatggtaaatgagctgacctatataaaggatgtgacctcctttctactttaagcgtattttgtacaatttttagcggagttaacacagctttcctcttggaagtcaacagacaatatgtaagactgaaaagtcaagaaaaatcaagataataatattatttaaaaacatgaaaataaaaaataatgaattaaagcagcctaggcatggtagctcacatctgcaatcctagcactttgggaggctgaggcaggatgactgcttgagcccaggagttcaagaccagcctgggcaacatagtgagaccccatctccaaaaaagaaaaaaaaaaaaataattagctgggtgtggaggcgtgtgcctgtagtcccagctactcaggaggctgagatggatcacctgagcccaggaggtcaaggctacagtgagccttgattgtgccactgcactccagcctggatgacagagtgagactctgtcttaaaaaaaaaattaaaataagctgggagtggtggctcacgcctgtaatcctagcacttgggaggctgaggagggtggatcacctgaggtcaggagtttgagaccagcctgaccaatatggtgaaaccccgtctctactaaaaatacaagattatttttagtacaagatcttcttaggattatttcctggacagtatatagtgatgttacaaccccagtgatttaaagcagatctctcaaagcaaaggaggaatgagcttttgtcaggatgctagtggcatgtccttagtattagaggaaaacaaagaactagattccttttgtttgcccccaaatcctttaacctctgagacttactataaatgatttacctgtttacactatgtcattgtgttctctctgggtaaggctcttaaggccttccacccaactgaatcaggcccacccagattatcgcttacttaatgcaaattgtattgaatgtggctaagcacagtggctcatgcctgtaatcccagcactttgggaggccgaggtggggagatcactcgaggtcagtagttcgagaccagcctagccaacatggtgaaaccctgtccctactaaaaatacaaaaattagctgaacatggtggcaggcacctataatcccagctacttgggaggcagaggcaggggcatcacttgaacccaggaggcagaggttgcagtgagccaaggtcacatcactgcactccagcctgggcaacagagtgaggctttgtctcaaaggaaaaaaaaatgcttattgaatgcaataagattaactcctttacttgtagactttgatcacatctataaaatactttcacagcaatacccgaattagtgtttgacagaataactgggggctgtagcctagctaagttgacattaaaaaaaaaaaaagactatcacaaaactaaaggtggaaacaatccaactattgataaaaaattaacaaaacatttgccacgatcacacaaaggaatactccttagtaataaaagggatagaaccactgacacattaaaaaacatagatagatctcacattacgctaagcaaaagcagcaagatacagaagtgtgtatgacatatatttacatgacattctaaaaaaaagaaaaaagtaatttataatgaaaagaataaaaattatggttgtttctggggttggggactgaccagaaaagggctcaagggaattttctgaggtgatagacatggtttttttttatgtcttgataggggtgtgggatataaaagcatatcaatttgccaaaactcaccatattatccacttaacattgtatacttcaatgtgtgtaaattttacttcaaaaataaaagaactgtaaacaagtaatgaactctatttaacaggtttactttttgcagtggcatggtttagaagttctgaaatcaccttttgtatatattaggcttaaacaaatgagaaaaattgaagatattgggaaccacattcttcattgttggagaagagagttccaattatggaaagggggaaagactataatataggctgtgatgctggttaagaatgggaggtatcaatataaattcacagttgtatatgtgtgtgtgtgtgtgtgtgtgtgtgtgtgtgtaacatatatgttctagttcaaatcttggcttccaaaactaactaaaatccaggaccacctgcagaaatggctgattccagagctggtgcagggaatatacaagatgagcctacaacatctttttgtgctaaaaagatggagatgctcaaagaagaaagtgcattaaagaatgatgggcacatgtcaaaggcacacaatagttaacttgaaggcattcccactgatggaatatgggacaatttagcaccaaacagaaaatagcaatggatcataatccactgaatacaataagaatgcaagtgtctatacttgcatatatattaataaataataaatattaataaataagtatacacaaataaggaaaaagggaaaattcttccttatagtagaatgccaactactaaatgtagaaagaatgggagtttaaaaaattagcaatgactgctaaaattagtaggtgaaggttttatgaggacaagatgtttacagtttcaaagtatataaaatatatagcgatacattaattacagaatgaaaaagtataacctgacagtggaggaacctggtcaacccaacttaaccaagtcattacactggtgtcacaaatattgggacaaagtgctatcacatgtctcctcaaaagatatactaaatagaacacagtatcacttcagtgggattcctaccgaaatgaataacctgaacctaattaggaagaagcagtgggcaaacacaagaaggacaatctacaaaataactagcctatccactttagaaatatcaaagtgaacaaacacaaggaaaagctgagaaatggttccagtttaaagaataccaaggtatgagcctggactaattgaagactggaaagaaagctacaaaggtcataattggaataacaaaattatattataatatagattaactaacagtactgtatcaaattaaatttcctgattttgataactaactgtgctgtgctgatgtaagacaatgtcctagttcttaggaaatatacaacaaagtatttagggataaaagggcacagtatctccaacatattcctaaacaattcaagaaaagaaaatagagaaaatgatgaagtagatgggacaaaaatgtaaactggtgaatctgagtaaagagtatatggaaattccatgtattattcttacaacttttctgtgaatctgagtaaagagtatatggaaattccatgtattatacctgcaacttttctgtaagtctgaaatttcatatacatacacataaaaacacgtaatataaggccgggcggggtggctcatgcctgtaatcccagcgctttgggaggtcgaggcgggcggatcacaaggtcaagagatcgagaccatcgtggccaacgtggtgaaaccccatctctactaaaaatacaaaaattagctgggcgtggtggcgtgcacctgtagtcccagctactcaggagaggctgaggcaggggactcacttgaacctggagggtggaggttgcagtaagctgagattgcgccactgcactccagcctggtgacagagtgagactctgtctcaaaacaaacagaaaaacacacaataaaaaccacataatataaataaagctatgaaaatactctattttcatatatgattaaaaatttccagaatcaaaagttccaagatttaaactcaatactagagtttccagtctattatttaatatactacttctaaaaataatttgtattttaattattagacatttatctagaattttggacaagatattcatgctaaaaatcaagaaaataactagaaaatttatgttatttcttttatgaagcattccttgacaccataagtagggttgattgttcttcctccatgctcccaaggtattttgcacataacattggtagagcacttagcatattgaattgtaatctgaaaatcaattgcatttccacatagtagcaatgaataattaaaaacagaaattttaaaaacttacaacagcaacaaaattatgaaatacggataaatctgacaaaatggggaagaattatacaatgaaaaccataaaatactaatataaaatactagtgagtaaaactgacatgaataaacagagacatacatcctagacatgtgtcaaagacaaaacattgttaagatgtcaattccgaggtgggcggatcacctgaggtcgggagttcgcgagcagcctgaccaacatggagaaaccccgtctctactaaaaatacaaaattagccgggcatggtggcacatgcctgtaatcccagctacaagggaggctgaggcaggagaatcgcttgaacctgggaggcagaggttgcggtaagctgagatcacgccattgcactccatcctgggcaacaagagcgaaactccgtctcaaaaaaaaagtcaattctccccaaacagatctacagattcaaagcattctcaaaattcagcaagctgttttggtaaacattgaaatactgattctaaaacttggcaaaatgactctgaaggagaaaaaagttgaaggacccatactacctgattttaagacttattataaagctatagcaaccaaaacaggaagaaagaaaacaacacattaataagcttacttcaaaacttaaaacttctgtgcttcaaaagtcactgtgaagagaatgaaaagacatgctagaaatatctgataaaggatttatatccaaaatatataaagctttcaaaactcaattaaaacaaaaaacaatgaaaacttaaacaaaacatagcttcatgggtgtagtcatacgtccaaacttacataattgtataaacaaatagtttattttatgtcaattatacctcaataaatctgtcttaagaaatggaatctgactccctcactagactctcagctcctcaagggcagggattataaattataggcggggtgtgttggctcatgcctgtaagcccagcactttgagaggccgaggcaggaggactgcctgagcccaggagtttgagaccagcctgggcaacagaatgagaccttgtctccactgaaaattaaaaaaaaaagttaggtgggtgcagtggtgtgagcctgcagttcctgctactcaggagtttgaggtgggaggatcccttgagctcaggaatttggggtaacggtgagctaggattgtgccactgtaccctagcctgggtgacagagatcctgtgtctaaaaaaagaaaaaataaataatatttttatctacattagcatcttgtaatgcaagaatataaaagcagttgagtaagaacttgccgaataaacataataattaatgagccaaagaaatttaactgatgattaaaacaatgagtccagaaataatccgaaggcactacataactgacgcatactaaaaattcacatctacaataaatgcatggtatggtaaaaagagcactgcactgagattaggaaacgtgagaaactcaaagtggatcttcactagctaggtgaccttagataaccaaacctcactggacatcattccatcatctgaaattcagggttcttaataattcttattttgtttacatcatagaattccttgggaaactaaataagacaagtaaaaaattcattcaaacccacaaagccatcagtattggtgtcattagaaataaattttttaagggggtagagaaaccacagatacgtgattctatttactcgagggtgaaaagcaacctggtctacttgcctgataggaaccaagacagcaaggactactccttcttttctgttttctgcctagcggtagacaagcctcgtttttcctgttcataaaaagacaaactgcctattctgatctgttaactcggaaaacaaatacttgttctgtctttttaaaagaaagtggctgaaaaatataacatatcaattatcatgtttctacttcatgttaatatagtttcagtgttcttctctgagaggaacaaggttagatttacttccttccctccttcatgggaaataaaaaatacacatacaaacacttttgtactaaacaagttaaaccctgggttttctaagtagacaccttttaacatgccaactgtctccttcgaaaaaagtgaatgcccttaacttgtttaaaatttaaattaatgaactatgatgaaaatataaaggtaaactggtaacagctactgagacagaagactgaatgacctttgtgatagctctcactagggatgggcctttaagacttcatagtcaaagaccttcacttaaggaaaaaactagaaggaatccattaaaatcttatgaggaattcatgacctcttcatgattttttagatttagtagtaagaaacatggttattttcccttattaggaataagagtttgtaacgatcatgggaaaaaacattcggagattaaaaaaaattctacttaccaatggattgttcccttggaaagcaggtttatataaacaccattttacccaaattttattagcatcactcaaacagtagtgattatgcagtaaatagaaaactcttgcttttaattctaatgattattaaaaacttagaaaagacaagcataaaaacgtttaatttccaaacatttttggaaaactccaactgaatttggacctttcccaatgagctggtgtcttgacaggcacctctagtactttaactctagaagatgtcaccagtactataagcaatggtgtctacttgttatcatttctatcagctctgctgacatttggaaaagatgtaaagatttgtgatgtctgggataatctgattcactagaggcaggttttacgttaaatacaggaatactctgcccagtaggtttcatgtctaggcacctggtttatgtgctcaccaaacagaagcagaaaaacaactctcagaaaacttaacaccctttagtattgaaactattttctggatgttgtacagaaacaagtaagagaagacaaaaaaaaaagaagaaatgggaagattggaattttaactctttccctctatctatacttactgaaaggtttttaactcatggctgccccaggcaggatcacaacaaacagagggataacactgtctgtataaaagtatttgcctgtttgcatgacctgtttcatattcttttaaaataatgataccaaccagatgtcccacaatgatgataaatttaatttatttccaatttctcaaactcttctacagattcaggcagcacagtcacagccattagctcactgagctggatgcatcattgaaggaacagaattgatcaggcagatagattgcagtgcatggctaagagtctcctaaggagggagatggcagaaatccagacatcaaatagatgatgaaatggccatttccattaaggtaacatcacatcacagatattaattaggaggcactataataaagttaagtggatgtggggggaaaatgctgagttaaaagtcaccccatatgtccttagcctgaggtaattacagatctgaaggtgagtcatggatctgcaattttccattcattttacaatagctgcaggaacgtttagagattacgtaaaaggagattagaatccttttttagactggggacaaattatctttaaaaaaagaaaatattcttatgttttccttttaacattcctgttttattcccaaggaaaatgacatcctttatttacattaacattaatggaggatgacaatgtactgactactttcttcttcttcttcttcttttcttttttttgagacggagtctcactctgtcactcaggctggagtgcagtggcacaatcccggctcactgtaacctctgcctcccacgttcaaaagattctcccacctcagcctcctgagtagctgggactacgggcacacaccaccatgcctggctaattttttggatttttagtagagatggggtttcaccgtgttagccaggatggtctcaatctcctgaccttgtgatgccccctgcctcggcctcccaaagtgctgggattacaggggtgagccacctcgcccagcccagttcttactactttctagagaaattaagcaaatgaaacaagttagctttaagtttaaatgcattttaccaagttttttatttcaagaatgtaaattcatcttaaaaactgatgggatattttgttctcagtgttcaatccaaatctaccttaagagctaaaaaaaaaaattttttttttttttgagacagtctcgctctgttgcccaggctggagcacagtggtgcgatctcggctcactgcaagctccgcctcctgggttcacgccattctcctgcctcagcctcccaagtagctgggactacaggcacctgccaccaggcccagctaatttttttttgtatttttagtagagacggggtttcaccacgttagccaggatggtctcaatctcctgacctcatgatccgcccgcctcagcctcccaaagtgctgggattacaggcgtgagccactgcacccagccggaataacaatcttttaaagtattatttgatgtacgtaaatgatgaagacagccatattccaaacctgcagagcttccctacaatagtatgagaccaatagccaaagtgctggttgctcaacaatagatttatgccagttttttttgttctgtaattccttgcaatcttatctcccctagtaccttgcccaattatatacctcccacgtgcatccatgataactaacaaatgcagacagatggccaaaatgtgagttgaggaagtgttgagtacaaaaggagtttatctttccatttcagtataatttggatcataatctcagaattctgaatgcagtactccaagtcactaacttcaaatggctgactgaggctctgtccaggaaaaaaattcctttgcggaagttccaatcttaatttcctacataaactcagacaatttacaattttttattttttgccttacttcaccaaaaaagcagaatcacagggataaaaatttacataggatgtctaaatgatgtagaataactcattgaaagctcctttatccacgggtgcttacaaaagataaaaagatatcagtaaaaaatggtgcagtaaaaacctctgaaaactctctcctccatgaaagcaatgtgaacactgtgatgagcactgtgagaatcaactgaaaagtagccaaaggcttgcagcaatccagggagtgcttattcaagaaaaaccagctgaatcttggtaaaaacaataaactttgcagtgttttatttgccttattcccatcccactctcccaagctccatctcggccttaaaaactaaccttcctgaatcacagtgaaaatcagaagccatcagagggggcaaaagaaagctgaagctccttcaaagcccaattctcagagaactgtcattatttgacctgtctggtggtcccctggagggccccgctcagaaggctgtctttactttacaggacttggagcttggccagtaggaaaagcataattcttttgagggtttgatgaaaacaattacagggattgtttaacactgaaacttcttgaggtggtggcaaacagctggggcaaacaataggctaaccaaaagcttcaaaggaaaaactgaagaatgagaatgtccacaaagggctttgaaaagttctaatatattaaaacaagaaggaatctagagggctcatgcgtgcccatggccatatgaatgctcaggaaaaactagagaaagccctcagctctctcctctgcctgaccttgacaggaagtgaaggctaaggcagaggcatcaactgcttagtgcagtgttgaaggtaggctgcacctgcacatacagcccttcaacaaagactattagacttcgttgagacttattagtttcaggcatctaaggaaatctgttcaagcattagctgactactaatctaacaagcagggacttcactggccacacacagaaagaacacagacatcacaaaattagtttagaaaagtcattgaaaaaacagcaagaaggatgaactgtgatgaaaagagaaaatctgatttccagggtcacattacattattttaaatgtccagttttaaatgaaaattagaagacatggaaagaaatgagaaagtatggcccatactcaaaaaaaaagcagtcagtagtaactgcccctgaggagcccagatgttggacttagtagacaaagaatttacatcagctatttaaaatatactgaaacaactaaagaaaactatgtctaaaaaactaaagtataagaatgatgcctctcaaatagagaatattaataaataaagggatagaaattataaaaaataaacagaaatttgtaattgaaaagtacaataactgaaataaaaaattcaccagtgagattaaaagcagtttagagcaagcagaaaaaacaaccagtgaacttgaagacagggcaattgagactgagcctcaggaacaagaagaataaagaatgaagaaaaataaacagagcttctgagacctgtggaacatcaagtgaatcaacaaacacgtaatttgggagtcccagaagatgaggaaaggggaagaacaaacatttgaagaaataatggcccaacatttaccaaatataacaaacattagagaggttcaaaaaacttcaagtaggataaagtcaaagagatctgcatgtagacacaccatattcaaaccattgaaagtcaaagagaatcttaaaagcaaaacataagaaaatatactcttctgaaggttgtctacaaatctatctgaggcacagtgtggcttcaagattagactttggagtcggttttgtcatgtatgtctttggaggtaatgcggttgggtacacattttatataactcatggggaaggtttttctcctattataatttttgggaataacaataaactaaattctacaacccaggtgagtgtttagaccccgaaactcatctccaagcagtaacagattctaagtggaaataaaaaatccactttttcaggaaaaaaaaatagtaccagcaactcatggtgcattaacggcacttatgtgggaatattcttttacgtacttgaataaaagactcaacttacatatggtgcctgattaagagtttcttaagagatatgaggtaatcatcatttttcttgatagcttattcaaagaaaatactgttacatagtgatctcagtctgaagaaacaaaaaaaaattaaatctctataacagacctaaagcatacacgtgactaaatttcccccctcctcctcccatattagcgtaaagaaatcaagaagaacaagaagaaacaccaagataatcagacttttttttttttgagatggagtcttgctctgtcgcccaggctgcagtacagtggcgcgatctcagctcactgcaacctctgcctcccgggttcaagtgattatcctgcctcagcctcctgagtagctgggattacaggcacccgccaccgtgcctggctaatttttgtatttttagtagagacggggtttcgtcatgttggccaggctggtcttgaactcctgacctcaggccatctgtctgccttggcctcccaaagcgctaggattacaggcctgaactatcgcgcctggccatgataactgaactttttcttttaggattcaaaatagggtaaacaaaaggttactgatttctctaaatactgttcctatgcttcttatatttacacaatgtcttcatactaaagtacaagaaaccacttgaaaattatttttaatagaaacaaatcactctcaaatggaagaattacaacagaatacatactagaggcatatcactatgttcttcttaagagcattattatgtcataaaatttcaaactgccaagcgtggtggctcacacctgtaatcccagcactttgggaggccgaggcgggcggatcacctgaggtcaggagttcgagaccagcctgaccaatatggagaaaccctgtctctactaaaaatacaaaattagccgggtgtggtgacgcatgcctgtaatcccagctactcgggaggctgaggcaggagaatcgcttgaacctgggaggaggaggttttggtgagccgagattgcaccattgcactccagcctgggcaacaacagcaaaactctgtctcaaaaaaaaaaaaaattcaaactgtggggtaactgaatagtttttaatccctcttcctcagataaagatgccacgaaagaaagaaaaggtaaaaataagatgtcttacttaagattaggaaaataaggctgtaataatttcaaaaactaagtataaattaatggataaaaatattgggactgatgcccatggaagataaaagctatactgggtagtctctagtcttcatgacagatattcacagatggggaagactaccccattttccaggcttcccaaaactaacctgtgataattagacattcattgtgatccagcacctcagtgaagagccgtgaaataatcaactcaggattgattaaaaagcggatttcttcttgcacaagtcctgcactggttacaccacctccaacaaaatgatttgcaaaatccacctgttggggaaatgtgacattaaataatggtcaaaaatacctacacatatgatcaagaagcacatagtctctaagctctcatcttttcctctcccatgaaaatcaatccccaaataagtaatcttcccaggaagggcagattttggttgcttaagctctttccacctcactgcagttaacatctctgcacatttttctggatcccagaaccagagaagcaatctggaaaatggagcttttaggcaaaatattatgaatcatacagactcttgtttataaacctatttgtgtctcatgggccacaaatcaagggaggtctttatctgggaaggtttcaaagtcattctcccccattcactactcaacttccctttatgtatttcacgtgactttaatataattaaacttttcttatgtaatatggtaaccaaacacttgccctaaagaactgaaaagtttagtaatcaactttttgggtaaccttttccaactttattgtaagaataaagagatcgaatttttgtccttctaaattcaaccccaaaccccaaactacatgaacattacaaactactttttaaaaatataactaaggaaaaaaggaagaaagaaaacccagtatagcaacaaagattcaattaaagtaatatttccaattaggttggaaactcttaagctttatgtggagtagtatgatgggatccccaaatgcctactaataaagaagaattacacaatcctccagagaaagcaaactcaacttgctggcattatttccgtttgtccagtgtgtccagcactatgccagcctcatgaagcagtatgtaagaaatagcaaccatcttttccttagtgagactatctgaggagttagatcacacacacacacacacacacacacacaacttgtgtatatacatagtcatacacacaagtaaaataggatttactaaataccatgaggcttatattctttcaaactattttaaaatatacgatttcttaaaacttcagtgttctctaaagcaactgatactaaatgacaatctgaagcctattttacaaaatagtaaaacaatagtatgaatcgtttgatatgtaaaaatatatgtcaaaagacagaaattaatagaaggcgaagcagtcttcttttaccacaggagaacttagaaaatactaaaacataccactgaggagttcttcaattgagctaccagagagaatcatatatttggatttgtgttctggagtactaaaaccaatgctaaaaaaccagagtaactctttagcttaaataggaaaataattttggtgaaaccagtctgttgattagaattagctacctactacatatgaggtctatgggcactgggtgattcatggcttaaactgtccaattcaacaactatttactgagtattgtgctgggaatcactggatacaaagatgaataagatatgtatggttcctggcctcacggcatttgcaatttagatggcagtcagaatgagcataagcagaatgagaagatgattattgaagagcttgttactatgtatttgatactttctaataatacaattaactaaaattggagcatgggaggaagataggaaagctttacaaggggatgtggcagctgacatgcaggctgagggcatagctgcacaaggacacagggcaaaaaaaaaaacaaatgtaaatcactgtatgaggggaatggtaaacagattcattgtgcttgcctgcagtgtagagtaggtggaggcttacagttggtgatgaggtggtctgaggtctagggaatttttactcaatttccctctgaaggttctgggaaagattcaagtaacacctggacctatgttttaggaagataattcaggctagagtttaaagaataaatggaaaactgtaaaactaaaagtaaaaatgctggttaggtgagtactaaatagtttatacaggcactactagggcctcaaacaggaaagtggtaaagtaaaggaaagagaagaaactcggtaaagaaataaaatggactgtacttgagaactaagagactggctgagtgcctaaaagtataatgatattgtgactacaaatgagaaacagatgaggtttaagattggcctaacttaatttttactggaataaggtacataacaaaaataaaaagataagctctatccaacttatgtactacttgataatgatgatgaaatacattcaatgtgtatgttattgtttactctttgaataaaaggcccacatttttaacttgaaaggtgtacacagaaataaagacactaaactcagtatgcctctaaatgccagagtcttttagaaaaccaaagttttactacttaaaaaagttcttaacaataaagaccctctacaacagttgagagacctgttccagtacatgaaaacaagaatgtgaatgcatccttatttttagccagttattttccaagtcactttaaagctactcattcagattactcagcttctgaattataacttgatgaaaagacaggaatgataaagctcctcagagaggttttgttgttgtggccattcagcatcatgtaatttatatgctacacaaggagctctgtagcattgcaatacaatattccccgatctcctgcggagacatggcatgggtagggagaacaattaatagaaagaagcccttacggtattctctaatctaccgaggtctcacatttccatctataatatattccaaggaagtggggaggatctcaaccttaactgttgttaaataattccttgttgaattgtattgtaatgaaaggtcagcattcctgtggtgctaactagcagtaactttgtttagttcatgtgtattaagaatctctcagtttatccaagactttaaagatggaaagaacttcatcaagaggggaatgtgggggaaaaagtgatactaatttgaaccaatatttaagcatattttaagattattttttaaacagaaaaaaggtataggagtaaatgcaaatttaaatatgttttgtttttgtttataagctcaaataaccactgggagaaggtgatttagaataaaacatagtttgtctctttgaagattttaattacaaatatgtccaaataaaaggccatttaaaaaagaatctcagtttcatttaaataataactagacgtaaattttatagtgagcattaagttattcaaacaaatcagtccattttcaggcaactgctttctttagattctgaaccaatataagcaccaaataagaatctaagaagaaaaataaactattatcagtataaatgagatggtatacaagcttctttcaaagaaaactcagtttacaatgctcttataaatgggataagaacacaaaacactaacattagtgaattttaaagaagcattataaatcaaaagattaggttagatattactatattttaaacacggggcttttgttaacccccttctccaaaaatactttttaaaggtaaaggcggtaacagattattaacaaagattgagaagtggaccagaattacctgcttttaacagggaaaagacatagcaaacagctagctcacgtgcgtgaaactgttacatatgagagagaggcctttcttatcaatcagttttagacgtctgccccctcaacctaaacaaagctgttggtggcagaaaaacatctccatctggtcatcaactggggcagagcaagaagagcctttaaggaaaaagaataaaaatgcctggtgacagtctgtcaagactataccctgggaacttcctccactgtcaacctactatcaatgtctgaaccaagaggctgatgctgtccagatcttgggattttctgtcaaaggctttttagagaagcacatataagaaacagagagtatacactggcaaatcacaacattaccaaggctgtcaaagtgatctgtttggtgtttttcttcattctgctatcatgcttctttgcattaaatcagtttaggagacaaataaacagtttttcaaatttcttttgctgtcagaagcttgacaagaaaaagtcctaaccatacacagacactactaagattcacctacctgtagcatgcctcggccattttcttctatggtaccttcgtaagtgacatgcaatcgtgtcaagggtttttcacatctacaatataaaaagacattcccttatttattattttaatgacaagttgttcactgcggacaaaagtgaaaatataggtaactattcaaaaaccgaaaccaccccaaatctcgaaagtcagaaacagatgcctactgttaacattcttggtattgatcctcctttattcaaacatgtaaatatacatatttaaattaaaattggataacatagtttgaaacctgattttcctctaaataatatgaaagtttttcttctttaaaacagttgaaaaacattacaaaatattaaaaaaaattaagatctatgaaattttgttatggctagagttggcaatctgaggaaaaatgtagaaaaatttggcaataaatcatatatgattctcttctggcttccattttctattttcactgtttcataaccgtgtgtgtgtgtgtgtgtgtgtgtgtgtgtgtgtgtgtgtgtgtcttgatgaaaatacctgccacagaaattctgaacaatggtatttttctattaataaggttaacagataaacttagtacctgtaatttagaaggcataattattttctttccctttcaaccatggccactgaggtatttacttgacttatgttatattaacaacaaattccattgtattaaaagtatttgttaacattatttgccttattagatatttttcccctgatcacttactgaataaaaaatataaatgaatgaaacagaggagatccaaagttctaactcacataagagtgcccataatcttttttgggagggaggagatgattatatttttagaaaatagtctaggaggttagctggaaaagtactgagaattgtttgattccttcctggtttcaatgagtttaaatacatttctggcaaaactccagcccaacaggctgatagctttaactcagaaggtaattctgcacaggttctgtctaagagccttatttgtattaactcattgaatcctctcaacaaccctattactatctccttttatagacggggaaacaaagcacagaacatctaagtaagctaaccaagactagtgaaataaagcagcagagatgtgaaactaggtagactcactcaagctctgaatcagtatgctacacttttagaaaaattactttcccagtctcttgtagaaaacagtacggtaagtttgatatatttttttaacttcctttttttggtcctactttcctagccattttattcagaggaagacccctgtaagcatactactaaaaagataaagaagcataatctaaaaatctctgggctgtcagtcaggacttcagaatgggaattccatctgttgtcaactattctccatgactgaagctagaaactttatagtatagctcttaataaaatcacgaaattgctagaaactttttcttggttttgttttgaagcattttctaacttcccagtaggtcatcctctacacccccgccccaggagtcagagacgtaggtgattctggctctctgtgattaagcctggctaaagtatttgctgataatcaaagggttaactataacatgccagaaacatggaattcaggaaagcctctaagttcctggacccatttagccccttacgcttgggaacaccaacaatccttatcttttcttcattctccctctttaagtgaatgcatgtttctggttctgtggagtctgggagactggttttaattatattctccaactcacttataaagcaactaaaacaaaaaagagatcaatgaaataaaaataagtcaaattctgcctatcaaaattaaggggacaatcttcgtctcacttagaggcaaagttactgtgtctcattgacacagcagccttgccagtctctgcattttgacctgtcccttctctcccacatggtggtatacaaatgggtgttctttcacattagtgccaaatgaatatcagatgcaaagtagagatcctggatgacttaaaaataagccctcagattgatctataaaatctacaccaaagtaacaggaacaaaacatatgcattcctattagagattaatagaagagtgaagaaaaacaatcctctgcaccatagagatgacacagcagaatggtacttttaattccaggtactatattttaagagggcccaatgaatgggagtatgttaagagcagagataaagggtttagaatccatattacatgtgaaatagaagaaacgaatcagtttagtatgaacttgtatgcactgttagagagggaagtaggttaagaagccattaagatacatgaaggagggtcaaatgttaaagaaaactagaaattcagatttatttatgtagctccagaaggaagaaccaggaatggtggagaatgaatgtagaaaacatttttagtgaatgaaagcatgagatgataacacaagcagccaccaatggaacaaactgatacgaaacagcggatctgccatcactgaagctatccagtcttctgtctgttgcaggtattacagagctgatcaagagttttagcaggcggctggggttcctttcagatctaacatgccatgatgccaaaatgctgtacatgttctcatctttttctggctcatttttttttctctcttcaggtcgcttaaccttttatctacttccctctattaataatcatctaaaccacgcactcagtcttctgaagtaaatttctttatctttcacttcacaaataaacatctttgatggatgaaaacactgcaggaaagccacctaagcagatatgacttctcaagttaacgtttttttaagtgatttccattcatcactaattccaaacaaaacaattacaaactatcataaaattattagaaagtgaaaatgggaggcattggttaaatatgtatttagtatgcttcatcatgtcctcaaacatatttaaaaagttaatctacacttctttaagtgtcctgggggacttgctttagattaagaaatatgttaactatttcaggacccttctttaagtatattgggagacttgctttagattaagaaatatgttaactatttcaggacactaaggactttacaaatctgaattagctcatattggctgctatctcctcaatattttctgataaataagaaacaaacagtaaatagcaacttccacaaaatctaccagtagtacacaagggcagccaaacttcaaaattcttgccactcgacgaactctagatggttactgtttactaaaatgtaaataataaaaagacttttctcaatcttgtcctccagaaagaaaagccataaagttcaaacactaaccaaaaaaaaagggtaaggagaaacatttaaatattggtgttccttttattagtgtcttcacatacaacacttctcaattttaaacaggactttgtttcagaagacaaaaccaagacaaaatggtagaaatcaaagggttatagactttgatttaaaaggcataaccttttcaaacatgagagctatcaatgaatcatttatgagaagaaattccctggcactaggataaatagaggttggaaaaccatctttctaggtgctataaaatagaatcctctcatggtgcaagagtccttctatttctagggggtctaggattatttttattattgttgttacctttcccattctggaaaatcttcaagactctgtcttgtaaatgtcaccaacccagtaggttctacagaagcaataaaagaaaaacatacccaaaataagtttcaattttgaaaagattatacacacacacacacacacacacacacacacacatacacacacacactcggtaaaagaataggtctaacattggctataaaactaaccaggaaatacaaagcctagcattggaaaataacagaatattgattgaaaataatatccttacagtagaaactccttctataaaataataagacttcactaaacgaaactatacaaataacagcacaacagtaggatttgagtgctggtatttttggtaaagtttttgaagctgaatacacttttttttaaaaaaaaaagagcattgaaaaaaaggatgtataactggtacagctaatgcaataaagacaaaattgaattcaaatttgtagactcctttacaaagaaaggacttaaccctacattcaaagactggagaataaatacacatttatgtactatatggtaaagtgaaatgtcacagatttaaaaaggaaatcatttgcacatcctctggagttagtacagctaagtctcaggcttaaatagtgggcaatcactctacttgttagtagcagtcgtagccagaggagaaattactggttctaagagtttacagaacaaagatgacatatttttcaaggagcaataaatttgggaggatctaaatgaagtactattaatgtagtcaataattttagaggatgagatccttttctagtcagatttatttatttattttttcaagctagtagcaaaagaaacaaataaatcagctggccagaagtaatttgtctgattcaaatcaaagaacaaactaaaaaggccatgccgtttctgttttcttgaatacaaaaaagctcttaaggaaagagagagatgtcaggaactattagtgatgacagtgtataacccagtgaaagcctggccatcatttcattcctgtgcacaattccacatttccttgttctcagtcaaaagcaggaaccactcaaaaaccatatggagcagttgcagtagaaaacaaatttttttgttaagatgggtcttacgtcttttagatacctaactttaagataaatggataacatatttaaaactcacaagtaagtggtcaaacaactcaaacactagtgaagcaattccatgaatataatagaaaacatctctcttgtcattcggtaacttagcagagaagaacatcaaatgtccttaatatatactaagagatgctaaaagaaattcataaacactgctggcaaagcaagaaaaggcagaagaacatggtttcttagattaacaaaaatgccttgagagcacgtctgttagcgttttttcgtaacaaggcaactttcatctcagaataggatactttgattaatcaaatacttcccatcataaaatcacaatatatactatatacaggtcataaattttcaaaaacctgatctataagacactttatctaaaactatatagaaagtaatttaattcagaaggctttttaaaatacttcagtctcaagatcttcatcagatataaaatacacatgtttaacaacactgaaaagttggtcctgatggaattctagtttatcaattctaaaaggcatgttttttcacatgttacatttctgaaactggaatacatcttttataatggaggtatcttaccataggtgtagactagaggtgaattttcccagagaagatgtgcatctgcttctgctgtcgtctgggaacactatcagcctgataccatctgaattaatcctttgtggcaggcctttgtggaccacactggtggtaaggctgcacactcaaagcttagggcttgtggttcaaattctcagagaaatgtttttttcctttctctatttagtgtcaaggttgagacttgcacgtttctttatggtccctttcctggaaggtcaagttaatttctcatttatccttaggtgtaccagccttgtgggtcatgtctcctactaaactccctgtcctgagtgttttttccttcttagaggtatataatataagagcatttttaaaaagtcatctatgacatctcagattcgatgaaatatggtaccttaaataagcttctgaagtctattgagtaggctccagaacttctacacaaccactcattatactgcaacctcttttattctctttagtatttcctcttcaaaccattagctttacacactgaagaccaagagcaatgttgtactgtatttctacaaagaacttaattaacatgtacagtgaaaaagtcagaaaataaaatgtctagttataatttatttcttcaaattcccaatacttataatggcatatacatttccagctgaaaaaacaaactttaagctttttcctcaaagtatctgaaatcctaaaatttagaaagccaagttagtttttagagaagacatacatgatttgactcccaggacaaaaaagtaaactctgtactacttagttataataattctacttaaaacggcaactcaaagtactgtaaaaacaaaacaaaaaaaaacaatagtaataattctaattagacctagaatggccaaaaaaagcagtcatttatttatttttttagacagagtcttgctctgtcgcccaggctagagtgcagtggcacaatctcagctcactgcaacctccacctcctgggttcaagtgattcttgtgcctcaacctcccgagtagctgggattacactctcccgccaccgcgcctggctaatttttgtattttttagtagaaatggggtttcaccatcttggccacgctggtctggaactcctgacctcgtgatccacccaccttggcctcccaaagtgctgggattacaggcgtgagccaccgtgcctcgccttacgtagtcatctttttaacaagtcattacaaattctaatttgattttgtgtctcataggtccaaatgattctgcattttaatatttcattcagtacagggcacaaaactgaaattcaataagctatgaggtaattccatatcagagaagcatgtaattttcccttaaatatcaaaatcctgataattgatttcattctaaaaatttaacaatgtccaatagcaatacattcaagggggaagatgccaagcacattgtaatgcaagagtaaaagaaggatatgagaaaaatgaccttaaaatgattcaaagacatattttaagacaatcctatgacccagaactgaaaaaaagccatttcacttgaccaggttgaccttacctacttagcacaaaggaacttttgaggtgttctggtttacatccacttgtaggaaaggctacccattgataatagcttacatttattaagcatgtatcttcttgtttaatatctataactaccctgtaaggtaatggccgttattatattatttcataggtgataaaactgaagcttagaggtgtcaagaaacttgaccatggtcattcagcttctgagataagagtggcaataccaatctattatcagctggtcattaccagtatttgttggacatttactattactgtgttagctgctatcagtttttggggaagcaagaatgttaaggttcaatagaggaagatggagatataaaactcagtacaaaacagttttataagaactccacaaagggcttaggggggcacaaaagagaggaatgggtagaaaagcaatgcgttagttgacttatgcaaataaactagtgaatacttctttaaataaagagcatccaaaatttatttcctggtcaatatactttctctggtttttattcatgaaaatcttttgatgtatattacagatttcagagaatatgggtccgatttcagagtatgtaaaccccgccccccctacatttagcacacgtttatgcttatacacaacataagcataaaatctaggttatattgtcgcatcattactagtgtttcaatgtggttgggacaggaaggtttacgttaaacacaaaatgttcctcacatgtcacttgacttgaactgttcccatcagcaagaaaaattacagtaagaatgaaaggaatttacttttctctgtgactcttctaaagtagcagaagagcgttttaagtttctccggtttccttgatgaacgtccctcaaacaatctaaaagagataaaaaataaaagagaatggaagataagttaaaatgccttaatgattcacaaaactacatccatattgctaccaagtaatacaaagaaataattcttccagaagacaattctgtaatgataagaactggaaaattggtttagattcaaatggcatctggaaagaactgaaaccaactagaaccagacttcttcaaagctgctcaaatcagacatcatttactaccaaccacatttctccaacctatcttccaccacagagaaggcaccatccagccctcccagtcaactggggtcagtcagtcagtgcacagctactttctcaatggctaataacatttataattcataatgttactacgtagtttgataagtaacaaaaacggtatcaaaaaaaatccttatctgagtgtttgtgaggaaatgagagtggaggggaatgggggtagggacacaggcaggtataacaagatatcagggctcaacaatccttgttaaacaactagattcttttatggactgaatgtttgtgacctctcaaaatttatatgttgaatccttaatccctaatatagctaaatttggagatagggcctgtgagcaggtagtaacagttaaatgaggtcataggggtgggactctaatctgatagaactggtgtcattttaaaaagcaaggtgagactacagtactctccctctgccatgtgaggacaagatgccagccaacctataagccaggaagaaagccctcatcaggaaccaaagcagcagcaccctgatctgcagcttctagcctccagaaccatgagaaaataaatttctgttgtctaagccacccagttctatggtattttattatggcagcccaagctgactaatagagatcctttgcatggtaaccacaacagtgcctaccctgtgtcatctagttttcagcaacccggacttggattacttaattccgttttctttgaaatgatgtggcattgttattggtaacatacaattcagtttattctgaggaaagaaaagcagggctttaaaagcattatgacctgagtaagtagctcactgaaagatttctaacacaaaagcatgcttttgagcataagatctagctttccaaaggcatttaaaaattatagagactcagtggctatgaatgatgaggtactcttcatctgcctctagtcatgtgctctgactttaaaaccagagacccttcaagtaaagtccatgttaataagtgctgaaatgggtaattatttttcatgattacaacagcaagcttatgtaactacgctgagagggaaaagttaattccatgagaaaatcctattgagcgactgaaataaattaggaaaaggaaaggaaatgcacatttcaaatggttccgttttcaatgatctgaaatctgtattcagggtcaatttctggaaaaacaatttatatgaatatttatttcctaaaaagaatactaatgtatgctagtattttaaccaaatctaaaatcagatctctttttaaaaatagtttaagacagcctgtgtgataatttttatttaaagaacctatctttctaaaatatttaatacacatactcttataatccagttgccagctgaaagaaaggctctttgagggtgcaggtttcagcatggcttcttctagaatagagtttatttaagtcaaaatgaagaagccacatggcagtttaattaaacatcctatatcaataaatatgatttactaaatgaatacctaaggctccactgcaaaatctctttctaggctcactatgcactagaggaaagcaatatgaatacaaaagtagccaccaccttttcctagagatgaattgatgtactatacaattcaattaaaggataaaagttcttcttcaatagaactattgcatagtgaggagaaaatggctgttgctcttaagaaataattctctaaaacataggaaaagtgtccctagcttccatatgcggtcatctgtataaaatcacataaaaggtcacatacttcacaaccatgatgacaaattattaactttaggagcctcgtgagactgcagatttattatcctggcgagacagactttcctggaagattttatggctgttattatcacccactacaaatgaacaccactgtttattttgtaggtacaaatcttaaaggtacaaatcaagcagaatctcaatgtactctgtttattcactgctccaatcctaacttcaaatcactgtgtaaccaaatacactttcccatcttcctgatagagcagggggaagtgggggaagtgtcgtggtgggtgtcgggggtaagaagtggagataaagtcagaggagatgaagcaggtttaaaatccttgtgacaattctcagacttggctgttgtgaaattttaaagttgtatgcacagccactcaaataaaatgaattatcctgatatggaagcaagtaaaaataacataaatagacaggcaaacagcatgaatgaaagtcatcccaggagtgatatacaatctgagggacagcttttgggaatgaggaggaaaacaaaaggactgaggctggagcccaagaaacgggtgaagggggagaagaaagatggggcagggaagatagagagaagagaaaggctgatagaaatggggttagagaaagagagcatgagagacagacacacagagagaaagacatacacaaacaggctcagagaaagtgaggccttctcataatcattaagcatcattcccccgcccccactttttttgtaaacttcccaacacctttcttttttaatttagatttttcaagtcctgggtatgtatatttgaaggcatattttaagtcagcagtgtgcacacaaaccaggccacaataactcctctacatgtagggaggacatttgggcatttaattgaaagataattacagattattaaagaaatcaaacacaaaaagccagtcaggaaatcttactttgttctaaacaaaactgttggtattttcaaagacagacatcagtcaaaggtcagacacttattagctggtgtttttctttgcatacttataaggagaaacagagttgaataaaatctttccctgaatggaatactgataacattactggaattttattctaggtatatccatccccacccccaccatgacccactatgccatttcaagttaagtaataatcccattagtatacagtaaatcaaacccaaagcactacaacctccattttaaaatacgagcaagtgatagtccggaacccagccagaaagtcattcctggctcttctgtgaggcactctgccatatggccccagcagcattttcaatacagggaagaggcagatgtaaaaacctcctgggctgaccactgctgagacccacaatttatctctgaccatctagtttccatgcaaactcagaagcatcgatgctaatcacattggaagcctttatatgaatgtttaggacctgaaaggcaagcagggaaaaaggtcaggggtatttaccataactaagcagggcttaaagaacacagcaataaataaaaaagggaagacatattcaatttattgacttcagcctcccaccacatactcttaccatttttcttattcaactagctagccatacctctcttttgagattaaatacactctcacacacacaactccccactgctagaaactataatcataagtagaaactatgcataaaaggaaataacacaataaaatgctacataatcagcttaacaaatggctcatcagattacgtactggatctttcagaagccacataaaagtggggggactttcagttgtttggcatttccggagcactcagagcattttgctcatgacaggctttgagatataataaaagaacactgagtttgagtagaagacagtgatcaagttccagttgtgctaacaattcatttattctccctgaaccttatcagtagagaggcttccctacctagaaaattccatagacagaatcaaagcaagccatcaaaagacagtatcaatggtgatgtacagttgttgttcctattatttgctagcttaggctcattaaaacacacaccatctcacagtgaaaggcaagtgcagacatcctggctgcttaggattctctacaacattgtggagactaacactaggttacctgccttaattcatttttcatgttctgctatccaaaagaacatccatcacctaggaagacaagaatatgcctgatttcaaatcttcaacggaactacttaaactcttatttggtgagaatgctatttgctgcaagcttaaatccgtcacggtcactctggacttaaaaatggctttaattcatttaatagatcaataattatttctaaaaatagttctaatttttgactagtcatgaggtaagaattattaattcagttcattcaaagggagactgtgtagcagaatggttaagggacacagcttctcaaaggagactacatcctgcgtttgaatctcaagtctactagttactgtgttaacttggtgaagtaacctcccctctctaaacttccacctcattttaaaaatgagtgtaacaacaattcctaatcaatattctaattcatatggttaatgtgacaagtaaatgaatttcagataatgctgagtaagctaaggtacttgcgctaaaataaggcattacataatgcccaggccaaaaaaatcaacattcatttacataaagcagttgcattgttctaattaatattcccttcatttaaaaaaatggcccagccttgattcccatcaagcccaacatgctgactttcagcgctaaccagctcagtcttcaggataaatgaccatgtacaatgaaaaagataaacctgccatcgccaagaagccccaggcttccccactcagaaggttggctgaaaaacaaaggtcttttaaaattaaaatatataataaaattggccgggtgcggtggctgatgcctgtaatcccagcactttgggaggccaaggctggtggatcacgagttcaggagactgaggccatcctggctaacacagtgaaatcctgtctctaataaaaacacaaaaaattagccgggcgtggtggtgggtgcctgtagtcccagctactagggaggctgaggcaggagaatggtgtgaacccgggaggtggagcttgcagtgagccgagatggcgccactgcactccagcctgggcgacagagcgagactctgtcccaaaaaaaacaaaaacaaaaacaaaaaagatatatatatgaatgtaaattctggtaattggttacaggaaattggaagtcaccaaagccaagccttcccaagacatcttgacctctgcctgtcagccatccagcagcgatgggtctttgctccctacagaactctgtggattctatttcttccataagaaataaaatgctatatgctgaataagtaaaatagggtgaagtagacacaatgacaatgtgtctatggaggagtaattggaaagaagctatccacactagcttttttggaaaagcctcaaaaaatctgtgaaattccaccctcaaaatcaaattacaaaaattgtccactcttattaactttgtgttcagcttgatttctgacaactgacttgttcttccctgaactattttttcttctgcacgtaaaagtaatatatgggctgggcgcagtggctcacgcctgtgaaacaggttttttatataactgcaattgcagattccaatgctctgtgttttctctcaattctaccccaattactaacgaaatcagaagtaaaagctatgtttgattatatgtggcttaaaaataaaacatctcgtaattcctaagactaagacataatatgaaaagtaaaagacaagagactgagaacaaagggtctaaattatagtcttagcactctgccactaaccagctccattactcaaaacaagtcacttaattctcaaatatttcatctgtaaaatttcttttcattcattcaagaagcatttattgaaggcctacaatgcatgagactttgtgaaaataacaaagacagttaagatccctgtcccactgaaatgattaaataagcaattatgaagtagtctaggtagtacagtaggaaaagtaggggacagtaaaggcacacatctggctgtacaaacctaaggagtaccttggatgcctctctctgcccatctaccaatcctgtccatcaccatcactctggctaccccttcaaatgtctccacacctctgtcccctcccctacactatcccagctaccatcctctttcccggtgcattgcagtagcctctccaattgggtaaactcatgtactctggcccctctctgcttgattcccacattacagccaaaataaacttttgaaaatgtaaatctgaacacatgtgctagtctccctctacccacatatctaatcctccaatgacttcctgttgttttcagatggcctagtgaggcacagcatggtccagcctccagctacttctgtagcctctaccatctccatgctccttctcactctctgtgctgcaaccacactgtcttctctcagtctctggacatgtcaggtccttcttgcaacagtgactttacacatacttttcccctgcctagaatgcaaccacctctccttctccttggcaaaactcttattcacccttttgtacttaattcaaaagttgcgctgggcatggtgacatgtacctgtagtcctagttactttagagactgaggtgggaggatctcttgagcccaggaatttgagaccagcctgggcaacataatgagacccagtctcaaaacaacaacagcaagaaaagttatttccttgaggaaagtttcctttattaaattatatctttctttaataaaacgtcatggtgctgtgcacctctccagaggtacacacaggctagcataggaacctggagtagcaaacctatcctagcagaatctgagacaccagaaaaactgatacgtgaactgagtactggaggaggaataaaagccacgtggaaaagagaagggcatctgtgacgtgaggtttgaaaatgagacaatactacataacagtaagaactcagaaactggcttctcctttctctgtaaccttatggcacttaatacactgtggggaatattgcagttgctcattgtacatttgaactaaacattgactaaataccagtatctaaaaacaaacttacctactgtacaaacttgaaaaatagattaaaaatatgccccttgcaactaatatttatgtaaccaaggagcatattatatattaaaaaaaaactatcctgtttgctaacactaggattttaaagaaattttcttagataacattatttttcattctttgctgcccctttcttagtgttgatagtagagggtaaccatatataataacaaattatcatcaatattttaatgtttgaaggtcataaaaatataacccaagaattatgacagtctaagagcagcttatattcaagtcatctgctatactttcatctgctaaacacacaataaatgcaccgaaatgtctagtttttaagtttaattaaaaatttacattaggaactaaccagctgaattctagaattcttctcatcttaagagagtaaaacattctccaattttaaaaggctaaaaaatatggtcttcggggctgacactctgatattggagagaattgtgaattcatttctctgctgccatgtggagttataaggaatgctgcccacataaagtaagttgcattagaaacaatgacactctagcagcaatgagcacacctatcacctagatgttggtctctaaataccgttgtacaataaaagagaccaggaatccttgagaaaatggttcattccaggattgaggcatggaaaatgtaagatgaatctggaacaatgtatgattccagaatgaaagttaatgctcaaaaaaaggatagggcttatcaaaagaacataggagtcaacctaaaggagccctaatggccaaagctagaataattaaagcagtaaaataaataatactgtttaatttaaactgacacaacaaaataaatatccatgagtccattctgatattttaaaaacgggggaaaagggatagctcttccttacaatggaatttcaattagcaaatgtagaagagggaagcagaaaattcacaacaggcaaacactatggtaataatcattgcagacaagatgcaccaatggatgccaaaattagtagggataaatgtgaggcaaaacaacatttgcatagtgttttatcttttggaaaatatttattaatcacaaaaggaaatatggtaactttatagtggaaaaagtcagcagacactacctttgccaactgatcaccagtaataagaagtatcatgatcccactgatatggtgcactgagaaggacacaggatcatttctgtggtattctcccaaaaatgcatgacctcattccaatcctgaaaaaacatcagccaaacccagactgagaatattctccaaaataactgtgatgagtactcttcaaaactgtcaagatcacgaaagaaaagaaaaaacaaggaacatgttggaggagactaggtaattaaatgtaactgggatgctgggtaggatcctggaacagaaaaaggatactagaaaaactggtagaatcagactgggtgcagtggctcacacctgtaatcccagcactttgggagatagaagcaggcagatcacctggggtcaggagttcgacaccagcctggccaacatggtgaaaccccgtctctactaaaaatacaaaaattagccaggtgtggtggcatgcacctgtaagcccagctactcaggaggctgagaaaggagaatcgcttgaacccgggaggtggaggtttcagttggccaagattgcgccactgcactccagcctgggcaacagagtgaagctccgtcttaaaattaaaaaaaaaaaaaaaaaaaaaaaagtgatgctactgatcattctacttcagagacaaaagcagtatggcaaacaaaagtgggttttgtttgtgtatccgctctatgactttatctcctactctgcatactgccctaccctcagaggcaggctctgggtgaccagaggcagtgaagggcattacacacagcctgctgggaaaggggcacagattatagcaattttctcaagtctcacactgaaatcagggaagaaaactcacatattctattcatgggtcctataaagataattctcaagtgaagaaagaaacagaggtggggatatgggagtagtgagtaggagggaagaacaaacattaatttgccaagaagattctttaaaatatttttgtttgtgtagaagatagagaaagtagtcacctgggaaaatggctggaatctaaaactttatcaataccttcacactgtattaatttagtcgagcagtttgaacattcttttgtttttcttttaaaaatattacactgataaattaaccatgtctataaagggtcaaaatcacctttcacttttcatcaaaacaattacacttttcaagtctcataagacagctcatgactttagactctcattttataagacctttgtagaaaggaggacttttcctctacctttcacagtatttcagcattaaggaatataagcacaacaaaagttctcgtgaataatcaaactgaagaggcatgtggagtccagagaactggggaatcatctgagaggacagaaagaacatgggccctggagtaagacaggcctgaaataaaatctcagttctgtgacttactagctcctggatcctaatcaagttcttttaacctcaatgaactttaatcaccttgcctgcaaaatggtgaaaatgtcacttaagtactgtaaaaattaaataagacaactgcatataaaatgcttggcctatggaattcattcaagaaatattattagttccttccacctttgtctttttcattgttaaagaggtgttttctgaaaacataccgattgaagttaatgtctgggtaactagaatactccgatttcatctgagcatttcatcgtggaaatgtgcagaagaaagcattagctaaaagactggcaatctgttcctgcgacattgtgatggaatgattcatcttctgtttcaggagtggtattggctgataaaagaaacaaaaaaatacagacgagaagagcaataattagtttagcaatttcaaaagcagaggcaccaaattgcatttgctaaattaaggcagaaataatttcaggccattcttgaatccttaaatcagcaatattgtaaaagtcaagggctgtttatcagggatgattcagaaaatgcacttatttgacaaactgcagatttctaatcaataataatgatagtgaagagaatataaaacattacttattagtgaaaaacaagattgcttcagcaagtaaataaaaacacattgcccatgtaatgaaaaattagaacaaaagatgaaacaaaaatatataacattgtttaagctaaattttgttcttatttatattaaaaattattggctagaataatctttcttagtcctcaataaaatgatctaagataattcaacaaataagtcttaaccctccctcttattccaaattacacttcatactcacaatttctttataagaatcaaatctaacttcattaaagctattaatagaacatgtaaaaaccaccatacggacatgtataagttgtaaaaagataagacatttcttacataaccaaacattccaagtcatggaagatgtaagacatttttccttcaaatcttttatgtctaaaatgtcttctagttatgccaccaaattcacttaccttttatttcagtataatccacacgacctgagtattgtgttcagtgggttttattctgtttgtaaaccaaaaataaagttccaagccccccaaccaactgaatgaacccctcctctcgaccaaggggattccaaagttaacctgaaacactagtccacaccatgataggaagtgtgggtctgacacgcctcattatatgctcctcactttagaattcagcacaagtgaccagcattaacaagaaaacagagaccttaaaactgatgaaacaaatctttttataataataagactcaactccagcctgactcgagtatagcatcacatgacagatagcataccttgaaagaattgaagtattttaccccaaaatatatttctttgacatattttgaaatagccctgcaaagctgtctgttgggaaaatgtacgttctgtaaagaatctctattcctttccaggtgagaattaagaaagggtgtggtacctttttagatctgataaaagctctgaagcctgttacaaggtttcatccacatgataaaaccttggtctccacaaacccttatcttaacccagatattcctttctattgattccaggtctttgactcttccaaccaattgccaatcagaaaatctttgaatctacctaagacctgtaagccccccttacatgtattgattgatgtcttatgtctccctaaaatgtataaagccaagcctgaccatcttgggcacatgttctcagatctcctggggctgtgttacaggccactggttactcccatttggctcaaaataaatctcttcaaatattttacagagtttgactctttttgttaacatattttaaatgttaaactatgtttttaaagacatgctgataaaatcaaagaccaactaccagtttatccttctgctgttaagtttcaaaatgctcccacagaatatttagagatgcatttcattctccccttcagtaagacccagaactaagagtttcgggtaactgcactcatctcaaaatggcatgcctagagcaaactgtcctgatcatacctcaggagtggacacccagaatgaacctgaggaaagggcaggcaagacaaaccaaaactgcggtgctgaataatgaatgcttttctaagtacagaagtacacaccactgctagaataagagtttgccagaaaaaagaacagattaaacttgtaattcaactatttctcttggaaaaattcaaaggtaaacaaataagcaaaaggtaaagaatgtattttcactatgtttacaaaattctctccccttcaggtcttagcaatcaccatttctgagaaaaatagagagctcatattgatctccattttccatcctgtgcatttgttcacaaccaagcaacgagtttagaaaaggtgacagtgcatcaatggcttcaagcaaagtgctgcttggttttaggaagaaatgagtttttaactaccatttaccaagttattcagaaaaatgattttaaaaattaatggtaaatatttcaggcttaatggacttcaaacacaaacatttcttgtctcccaaataaacaaatagtataattttaaatagagttaatgatttctcctctcttggtgaggagaaatgcctaaaaactcattatttggagaaatcaggagatgtaaatcttactgtcaagcaatcggctcaacaaaataagaggctggttactgtgaaccaagatatttcaaaaagttcctgaccaaatttgtttcctttaattttattttgataaatctaaaatttaccctttagatttggcctagagtacttcaatgtgataaattattaaacaccaacatatacaatttaacttgccacaagacgtattttgatctcaaataaaaatcttaactttcacagcagagattgacttttcaatagggggcaaagcacagaatttccatgcctacccgttgatatgctaatggagaagaaagtcactgagagaagccaggacaaaaagctgaggactcaggggtctgattttggttccaagggacttgttatagcttacaaagtcagatacctttgaacaaaaatttctcattaaataaaatatggaaactctcatatgcacgaggggaagaggattaaatggcccacacccaaaggctacctactacctattattgattatgaactacatattgaattcaaaaagcatataattaagcaccatgcaaaccagggacacaaagaggatctccctttaaggagactataatccagtggcaagagatatataatgacaagaattacaaaacaatgatttgagtgcttcaagagggatgaaccttgcctgggaggcagggaaggcttcacaggggaagtaacagacaggcatacctaggaggtagggagagaatttactaagtaaggagagaaaggaaaaagaacaaacatggaatatgatcaagcaaataacttccaacagaaacaagaagatatgttttaaaatatatttcccctgcccaatagtaaaacttatttcaggcacaatgcattactgaggtgaaattaaagttacataaaattgaaaacatcacactggaaaacatttcatgggtctcaactgaaggtggcatagtccaggaaggcatttggacatgtatgggttgttttctggttgccccagtgaccctatttgtggtttttggggtgtcctaatgacatattgcaatgcatgggaccattatacacattcagaaattgttccacccaaatgtccatagggcccctgtggagtaaaatgctagcagaaccctggctagcagccatgcagcaagaggcgttggccctagaaataaaagacaaaggcaaattcaagcacggttgtgagaaacacaggaataaaattatgaacaaaacaaaccctgtggaggtttgaaaatacgttcacaaattctttgatgctcctctctttaagaggtggagtcttgggcacggtggctcatgcctgtaatttcagcaccatgggaggcaaaggcgggcggatcacatgaggtcaggagttcgagaccagcctggccaaaatggtgaaactccgtctctgctaaaaatacaaaaaaattagccgagtgtagtggcacatgcctgtagtctcggctactcaggaggctgaggcaggaaaatcacttgaacccaggaggcagaggttgcagtgagccaagatcatgccactgcattccagcctgggggacaaggatgaaattcagtctcaaaaaaaaaaaaaaaaaaaaaaaacaggtggtctaatacccctccccctgggtactggctagcttccaatgaacagaaaaacagcagaagtgatgctaggtaccttgagaaaaataggtcatagaagacactgcagcttccttgctctctcccttggattgcttgctctggggaagttagctattatgtcataaggacaatcaatcagcctatagagagacccatgtcagggcgttctgccaacagctctgtaagtaagccaacttagaggtgtgtccttcagccccaggcaagccttcagatgactgaaaccctggctgacatcctcaccgcaaccacgagagaaatcctgatccacaaccactcagtcagctaatctgctcccaaagtcaacagaagctgtgagataatacatgtttattgttttaagccattaattttgacataatttgttatgtagcaatatataattaatgtactccaaacaaaataaaatacaggattctttatttttaaaagttaaggctggcacagtggctcacacctgtaatcccagcactttgggaggccaaggcatcatctgaggtcaggagtttgagacgagcctggcaaacatgctgaatcctcgtctctactaaaagtacaaaaagtagccaggtgtggtggcgcacgcctgtaatcccagctacttgggaagttgaggcacaagaattgcttgaacccaggaggcagaggttgcagggagctgggatttgtgccattgcactccaaaaaaagaaacttagccgggtatggtggtacatgcctataatcccagctacttgggtggctgaggcaggagaattgcttgaatccaggaggtggaggatgcagtgagccaagattatgccactgcactccagcctgggtgacagagcaagactctgtctcaaaaaaagttaagaaagtatcattaactcatttgttgtagaatttgggggagggtgaggaaggagtgggtcgtattaagccattttgaaaatacgctattccaaatccactagtatgttttgaaataatgaatacttttttaagttagaggttatttaaacaaagagagaaaaaagtcaaagtaaacaagcttcaacagtgtaaacagaagctgaggaatggaatgctgcatttttaatgtccttttgtagtactctctaccctctaaccttttccttaatacagcaaaattactatactctttggcaaaaactgtttcccatttcttctcttctcttctcttcctctctctctctctctctctctgtctctctgtctctctctctctctctgtgaccctggccattcaagtttaagggaaattcaattgtcagtctcagggaagctactgaggaagctacatccactaacctgggtgcaaatatttggcagacagagtgcaattttcaccatatcaggcaagatggactgatataaatgttgagcttctgtttcttcaagtacctgaaaaccaataaaataagttatgtgaataacaataaccagtaaatataataaccaatgaatatgtttgttatgaaattaaattacatatctgcttttcatggaaccccataaagtggcaccctatcagcatcaccaaacacatgtacaaatgcatcaacaggtgtatacaaataaacttacaaattcatttccaaatgtatatttggcattaaggcaattcaccttaatgccctctgaaaaaaatgtaagtatcccaaatatcaaatatccctcacacaacattcacaataaagtaaaaacacttgcaaatggaaaacagtacattctgcccttggttatatcaactagaaactgctagacaccagggactttcttagaagcccccaaggacccatctagtttcaatggtctacaattgaagaaatctccataaaagccacattaattacttcagagcatactctatgggtcaaatctaatctgttgggtaataaacaatgaggtttctgatggtcttagaatttctcttttccagacacccttggaaagtgaaaaccacaattcccatataaaaatttgaagcacaacaaagatgccatgcatggtccatttttgtcttttataaaatttcccctctctataacaccttttaatctaatgtctttctaaacatcagggtatttctttaaaagtactggaaatgacaacactcttaatttagagatactacatatacagtcaggactgaagtaaatactttatctacttgaaatcacattttaactagaagaggcctcagttataatctagtctgagcttgtcactattacagagaaaactgaggccaaggaggttacctgatcatcctacattgaggtcaattaaaaccaaatcagaacaagaacctaagtgttctggtctctatgccacagctcttcctacttccctatgtgaccaatgtttggaatcgatgaagaaacagactcttgacaaaaatcaggaactaagctgaaataaaggtaaaaccatttgtttatctgcagccggacagggtatgtgtgtaaatagaaaaagtaacaaagaatatttgccctgattttgccagaaaattctaacactaagaattttctttacaccaaaactctaaaacccaacctatgtttacttctcttttaaaattaagataatgagtaaacacattcagaatgaacagaaggatatttgtaattcagagagttggaaattcaattagtcataagcatacagaaaattaaacaaaagacaattattaattctggagaaaaagagttgtttaagagaggaaaagcaatcacagcccatatatgaatagtgtttatactatccaactgaaaaaagactactgatgtaattgaaatgaatatgaaaactatagtgagaaaatgcagaggtagaaatgaggtttgcatttatggtagtggagaaagtgagaataagagctaaatcctaatcttctaaagtgggacttgttttaaaaagactttagagtagtcaaatgactgcctctttataatctgcctctttaactctgttaaaaattaaaaaactaaatttttaaaaaatcatatattcatagatgacattctactattttagaggtatgcactaaagatactggcttctctatacctgaaaatatataaaatatattaatgcatttgtttaaaatattcaaactcttcctgtttataatttatctttttttttttttaatagaaacagggtcttgctctgttgcccaggctggagtgctgtggcatgaccatagctcactgtaaccttgaactcctgggctcaaaaaatctcttcctgcctcagcctcccgagcagctaggactatacaggcctttttgctttttaaaactatgtattctgaaataattatagatttacaggatgttacaaaaatactacagaggtacagtatacctctcacccagtttctctcaatggttacatttcacattactataacatactaaaaaccaggaatacctgtacaatgtgtatcattctatgccattttatcacacatacatttctgtaatcgccaccaaaatcaagatgcagaaccattccactgcaataaagatctcatgctacccatttatagtcacactcagcttccttcctctcgctattcctaacacctaacacccactaatttgtttttcagctgaaaaattttgccatgttacctacatggaaacatacaagtcttttgaaattgacattttttacatggcttaatgcccttaaaaggcattcaagttattgcaagtatcaatagttcactcctcctcattactaagtagaattccatggtatgaatataatattatataatattccatggtttgtttagcaatttcacctactgagaggcactttggttgttttcagttttgtactattataaataaagctatctttagtctcaacctatctatattgttgtctgaaatcacttcctataaacagcacagtgtgtcatttttaaaattcactctgcacatctgtcttttaacagatgaatttaggtcatttatgtttaatgtagtctttgatatgttgaaacttaaatctgttatttcattttatttcttttatctgttttcttttcccttcctccttatgggttacttgaacatagtttaaaattccatttttgtttatctaaaatgtttctgactgcatctctttgaatagattttttttaaagtagctgctgaaggactgcattacatataacttaccaacatttactggtgtcaacatttcaccagttccagtaaagtgtagactttaccttcctttaaattcctttacccttctccatttataatcttcaatatttcctctacatacattgataactatactattttacaatatttgaaaacagtgaaaaaagtcaaacataatttacaacactcaaaaaagtttttaaaaagtctattatatttactatatttttactctttgttgttctttcttctttcctgatgttccatgattccttttttttataatttcttttctgtttcaggaaatttctttagacattactttatgttaggtccactgatgtcaagttctgttttccttcacctgagaacactgtggtttcctcttcctttctgaagaatatcttaattggatatggaattctgggttgacaattctttccttagtcctcaaaattttgtgtcacttctttctggtctccatgtttgctgctgagagatccgttgtcattcaaactgtttttctgtataggcattgtgtcatttctctcttgctgctttcaagattttttctttgcctttggttttaagaaatgtaattatagtatgtcttggtatgaatttctttgggtttatcctacttaagttttggtcagcttcttgaatctgtagatttatgacttttgtcaaattttggaagttctcagccattatttctttgaatattttttcagtcccaccctctttcccctccctttctgaccacacaaagacacaaatgttatatctaaactctgggttttgttttttcatctattttctcactgctgttcagactgagtaatttctcttaatttcttccaagttcactgattctttcctctatcatccccattctccattaaacctgtctattccattttaaaaattcagttattatatttttcagttctaaaatttccatttggtttctctggatagtttctttttctttgctgggactttctgtttttttcatttgtttcaagtatgtttataattgctcagccttcttgtgatggctactttaaaataattgtcagacaattcacatctgtattctcctggtgtctattgatgttcatttttcatttcagttgagattttcctgattcttttctggtcatgagggacattttgttgaaatttggatatttggggtattataaatctttagatcttatttaaatcttcagccagagcaggccttctgtgatactgtgccagcaggggaatgggatagctacttcattaccagcaattgagggtaaaaattcatgttccccagtcagcctttagtacccaaagtggaaagtgagagaggtacctcgatagtgctgggttggggtgagagttccagctccccactaggtctttactgataccactttggtgccatgtactctcctagggtcccatagtccctgctggtcagtggtcttctacctttcagagtcttatgtttgttttacatacaaggtcccctgtttttcactgtaattagtgggaaggacagacagaagtgcctattcaaccatgttaaacctaaagacatgaaaccttaagtgtcttaacaagctgacacgtctcctttgggtatccatctttgtcttttaaaactgacatgagtggctgctgcagtgctctgctgacaagctttacaatattgcttatttatctgatgaagcattattgcactgtacttcttcacaactgtcaacactccagacctatgtctaatgctgctttggaaacacaaaaagggaacctaaaaatgtcatttaagaacataagcgactcaactactgtttgagatggaatgcataatctaaaatatcaccatgaccttataacctgtacaatgcaaactgggatgcaagtagggaaaagttatttaagatgtacatcatttcttaacttcaagaaaagcaagagccattggtcaaatcttctataacaattaaagaaaaataaacatacattacttattatgatgataatgatgattataagggaggtaagcatttacatgatggtaaaaaaagaaagttgtattaaattctcccacaagtaaaaccctgccctctactggatagtctgcatagataattacatacagcaagtgttttgatctgtgcgtgtgcgcgtgtgtgtgtagcaactttttattctagtcccacaaattggctgtatatatatgtaatatatattatacatatatttcagtcaaaattgatacaataaatttcaaaattatactgctattttgcctatctcctttccttagattatagatatgttcattcattcgattggctgataaacaaatacctgaggaactattatgtctcaggaattgtgccagaagatgacagaagagtaaacagttaacagacgtggtcactgacctcatgaatctcatggcacaaagccctatcctctccctgtgacccccaatacatcagccctaacctaggagggcagtaataactgcaaccacatcatagtgactgtggacaggctatttttttttcttctctccacaaatagaaacaagctactaaaataaaggaactaaatctgccaaacatcaaaacgttataaatatttaaatatctacaaacatccaaacagaaaagagatatttacttatttcttctttctttgaatatctgattaactacatacatctgttaaatgtgctctaatatttatgaaagacatatttatacatgactaagtaccatacctgacatatggaaagtattaaatattgactactgaactttgaattaataagtgaaatctgtagctcgcaaaatgagaagaccagtgttatttcaataaaagaaaatatttccatagatctttttcaaacagtttagggcaaacagctttaaaaaagtaatcaggccgggcgtggtggctcatgcctgtaatcccagcactttgggaggccaaggcaggcaaatcaccaggtcagcagatcaagaccatcctgtctaacatagtgaaaccctatctttactaaaaatacaaaaaattagccaggcatggtggcacatgcctgtggtcccagttactcgggaggctgaagcaggagaatcgcctgaacctgggaggcagaggttgcagtgagccgagatcgtgccactgcacttccgcctgggcgacagagtgagactttgtctcaaaaataaataaataaataaataaataaaaaataaaaaaaaatcacaaattaatgaatataagaaatagcacaagctgctccgttttctctattggtctaaacctagttagatcctaaaaaaattgtgaaaagttactaacaatcctctttaataaaaaaaaaatgaaatctatatgaaacgtctaggatgtgaaattttagacaatttttcaataagaagtacaccactccaaaagctaaatagcaaagaggatatatcctcataatcctatggtccatatatatatatatatatatatatatatatatatatatatatatatttttttttttttttttttttttttttttgagatagatctcactctgtcacccaggctggagtgcagtggcatgatctcaggtcactgcaacctccacctcccagattcaagcgattctcctgcctcagcctcctgagtagctgagactacaggcacgcatcaccacacctaggtaatttttgtatttttagagatggggttgcgccatgttggccaggctggtctcaaactcctaacctcaggtgatccacctacctcagcctcccaaagtgctgggatgacaggcatgagcctgtaatactgaagatgagtgatggaaacagggaggttcattaccccattttatttttgtgtatgtctgaaatgcttctttaaaaaaaaatttcctggccgggcgtggtggctcacacctgcaatcccagcactttgggaggctgaggtgggtggatcaactatgttcctaatagtaacataaccaatatttatacctaagtttctttttccttttacataggtgcatttatcagtggaaattatgttgctcaatttagtattttttctcaccaaatatgacaaaaaggcattttttacatcactaaaggcaaaatgttttttaaaatgtcatgtattttcactgaagaaaattaatataaacaaaaagaaaagaaatattacccacaagcccactgccaagatatcctcttctcagatataaacagatgcgtatttcctccccaaacttcttctgagaacttaggtgtgtgtgcatataaacacacagttttgtgttaccttaatttttaaaatattatatttttctacaacttgtttttgccttaagagaaagcctaaaaagtctttccgtattatacaatgacaaatgctacacagtattccaaagtagagaagtacaataatttttgtaatcattcccctttgagaaccatttttcccaacgtttttaaaaatttcaaaaatatggtgaagttaaaataactatacactgaatacccaaatactatttggtttctatgattaacattttatatttgcttttgtcatgttgtcatcagtccattcttctgaccacatatcaatgcattttttaatgcgttttgaggtaagttgcaagcattccaccccatcacttcagtttgcatatcagcaactagagttcacgccaggcatggtggctcacccctgtgatcccagcactttaggaggccaagccaagtggatcacttgaggtcaggagttcaagaccagcctgggcaagatgatgaaaccccatctctactaaaaatacaaaaattattttattgtatgaatacacccacaatttgtttattcattctcttgttgatagatacctgggctgtccccaggttttggctattataagtaaaactgctataaacattcttctacaaatctttttgtgtgcatatattttcatatctcataggtaggtatagaaagaaatgaaattaatgggtaatagggtaagtatatgttcagttttctaaaaaacagccagacctttttccaacattgtagtacattttaaactcccaacaacaaagtatgagagttgcaactgctccatatcgctacctacatttgatcttttagtctttctagtgcctgcaggctaatatcttttctagttataactggcatttctccagtgacaaataatatcaagcattttttaatgtgcttattggcaatttgtataccttcctttgtgaaatcctttcaaactcttgctcattttctagtgaggttggctgtctttttatttttcaattgtagttctttatatattctggatacatgtcccttgtcagataaacattttgcaaatatttctccgtcttttaaaatttatttatttctatttatttatgtgagacagggtctcactgtgtcgccaaagctggagtgtcatgatgcaatcacatctcactgcagtcttgacctcccaggcatcaatcctgtcaccctcagcctcccaagtagctgggactataggtgtgtgccaacatgcctggctaatttttgactttttttttttcctttttttttgagatggagtctccctgtgtcgcccaggatggggtgcagtggcgcgatcttggctcactgcaagctccgcctcccaggttcacgccattctcctgcctcaggctcccgagtagctgtgactacaggcacccgccaccacgcccagctaatgttttttttgtatttttagtaaagacggggtttcacagtgttagccaggatggtcttgatctcctgacctcgtgatccacccgccttggcctcccagagtgctgggattacaggtgtgagccaccatgcctggcctaatttttggatttttaatagagaccattgccatgttgtccagactggtattgaactcctgggctcaagcaatgcatctacctcagcctcccaagctgctgagattacaggtgtgagccaccacacctggcctccaagtgatccttccacctcagcctcccaaggagctgggaccacaggcatgtgccaccatgcccagctaattaatttttttttttttttttttttttgtagagacaaggtctccctatgttgcccaggctggccttgaactcctgtactccagcgatccctctgccttggcctcccaaagtgctgggataacaggcatgagccaatgcgcctggcatccctgtctttagcttgcctattttcctaatgtgttttcgtcacaagtatttataagtttttttcttttatagctaaggtttcccattagctataaaagctgtaggtcctaggaaatctttgtcgactcctaagctacaaagatgttttcctctagaagctttatagtttttgctttttcagttagaatttagaattattttctatgtatagtatgtgggaaggggcaatttttttttttaagcccacatggaaatccagtttcgccaacaccatttgttgaaaagacacttcttttcccttgttgtattgctttggcacttttgttgaaaaccaaatgactgtataaacatgggtctgtttctgggtttaccacttggttccactgatcaatttgattgttatgtcagtatcatattgtattcatttccttgagctgctgtgacaaagaaccacaaaccaggcggcttaaaacaacaaaaatgtattatctcacagttctggagtctagaaatctggaaccagttgttggtagtatcacgctccctatgaaggctctaaggctcttcctggcctcttcctagcttctggtggcttctagcaatccttggggttccttggcatgcagatacatcagtccaatctctaactccatcatcatataagcgttttccctcagtgtctttgtctctgtgtcctttccttctctcataaggacaccagtcattgatttaggatacaccataatccagtgtggcctcatcttaactagttacatctgcaaagactgtatttccagataaagccacatcctgagagtccaggtgaacattaatttggggggacattattcaactcaccacacatactgtcttgtttactgtagtcttattgtaagtatccaaagcaattcacgtaagtctgcaaactctgcccttcttatttacaatttctttgtaaataagggtcctttgtgtttccatataaattttagtaatcagctttgcattttctacaaaatgcctgcttggtattatgattggaactgcatatagggagaactgatatctttttatttttttgagatggagtttcactcttgttgcccaggctggattgcaacggcatgatctcggctcgctgcaacctccgcctcctgggttcgagcaattctcctgcctcagcctcctgactagctgggattataggcacccaccaccacacctggctaatttttttgtacttttagtagagatggggtttcaccatgttagccaggctggtcttgaactcctgtcctcaagtgatccacccacctcagcctcccaaagtgctcgattacaagtgtgagccaccgcgcccggctgagaactgatatcttaaccacactgagtcatccggtccatgagcatggtagatattcttttattcaggttttcttcaatttctcccagcaatgttttacagtcttcaagatactggtcttacacattttttgttaaatttatttctaagtattttatggttttttaacactatttttaatgaaatttttaaaatttcatttatggtaagtatataaaaatataatgatttttgtatactgaccttatgtcttgctaaataaattagttctaatagttattttttaggtttcttgggtttttctgcataaacaaacactgtcaactacaaatagaaacagttttacttcttcctttctgattttcaaacattttatttctttttcttgccttactgcattggctaggatttctagtacaatgttaataagaatgaagagcatggctgttcttgcttttcccccaatctttgggaagagtatttcatatttcaccatgaagcatgattttagtagtaggtttttcacagatacgctttatcagattgaggacatagttgttaatagttttgttgttgttgttttgtttttgttttttttttctggagacagtcttgctttgtcacctaggctggagtgcagtggtgcgatcttggctcactgcaacctctgcttcctggattcaagcaattctcctgcctcagcctcccgagtagctgagactacaggtgcatgctaccatgcccagctaatttttgtaattttagtagagatggagttctactatgttggccaggctggccttgaactcctaacctcaggtgatccacccgccttggcctcccagagtgttaggattacaggcatgagccatcactcccggcctgctaacagtttttcactctgaatggttactaaattttgtcaggtgcttattctgcatttatcacaataatcatacagcttttaaaatataaatccaatcctgcatttctgagatgaactctgcttagtaatcatgtattatcctttttacatatttctagatttcatttgctaatattttataaaatctttgtcacatactagtatgagaggtatatatatatggctttataaatgagttggaaagtgctccctcctcctctcttatttgagtttctgtgaacttagtattatatcttccttaaatgtttcggagaactgatcagtgaaaacatcttggtccacatagtaaccaatgtttaattaggcatattttactaggtattaatcctttgtctcatatatgttaaaatagtctcccctgtctgtcatgaaaccactagttttattatttttattttttaatatctagaatatagcatacttgagcccctttttcagttttatctttatcctttctgttgcttgtttgctactgtccagtgatacttaaccatttgcacctccctaatgtaccatactgacttcattaaatactatgatcaaatcacaaccttttgaacctattttcttacttataaaatgaaaatatcttgcagagatgtggtcagaattataagcttttcaacaaataacagctagtattatgatgatgatgatgcattattttaccctctgccttgtttaacattttactaccattaaaccacgaattatgcttcaggactcagttcccatctccctgggaagccttcgctgattgcctgactgccccttactctatgactctagagccaaatgtacatacttgtattagaacacttactgcggttattacaattatttatctgcatttcctgtcctctgatctgtgaaacacacaaatttaaacatcttgtggccccccagtactaagcatagtatttagtgctcattatttgctgaataaagagttgataaaaccaaaaacattgcattttatcttcaaagtatccttgcaagatagaaaggataagggcatctagagagactaaagctccaagaaataagcaatttgtccacattcaaaaacccagtggtggttgggggcagtggctcacacctataaccccagtattttgggaggccaaagcaggtggatcacttgaggtcaagagttcaagaccagcctggccatctctactaaaaatacaaaaattagctgagcattgtggcccacacctgtagtcccagctatttgggtggctaaggcatgagaatcgcttgagttcgggaggtggaggttgcagtgagctgagatcatgccactgcacctccggcctgggtgacagagcaagactctgtctcaaaaaaaacaaaaaaaaaaaacaaaaagacattgggactagatgccagagtttttcttcccaggttcacaaggaaggatataaaagaaatactggccaagaaactggaagactagttataggcctagatcggcatttactctcatattaaccacagaaaaatccctaaattctttatttcctcatccatagtaaggataattctactataactttaacttacagagttacgaaagctttcagatataatagggttttatgaattctaaagctccatataaaaagtattaatgtctaatgggccagtaattcacaaactttctggagcctccttcttctttgatcacccccatatcaattaactgccaagtcctatattgattgatccagcaggatctcacatatttattacctcatcttaatcactactaaactaccctcagccctcatccagtctcatcaagattactacaataatctaactgctgccctgctgatagcccaccttcagtttctgcccaagtagactatgatgtgcttctgctccacttcaaagctttcaatggctttctgctgccttttcaatacagaacaaatcccttgaactaacagtcaagctcccttaccctagattcttatctagtctcattcagcacatatatataacatacacacactcacaaactctaccttctgtgcagcctacatactagaaactcagaaattcatttttctatagcatctgtttgtgctgctacagatacgatcctggaatatctttccttcttaactccaaaacttatccaaccttttgatcttgctcaaacaatagtttgcttcaagtctatccaaatttactctccagctaaaaagtaattctccctcttgtaatttatttgaactttttttcacaagacacttaagactttctgctttctgttgttatttatgaacgtgccttctagcccttactagaagctcctttaagacaagatttatgattgattcaccattcctacaacagtggtgttcatatgtaaaactgtcaataaaaatatgttaaattaactgacactttctatctggattagctgattttacaaagctcatcctcctcctctccattgcctttcagaatctctattacttagcaaaaatattatagttttgtgtaagttgattaaactgtctataggctaagctttctatactggaactacctctaagttttcccaactctaaagcacaagctcacatttcaaaaattaaaagtacaaaaacattaaatgttagaggaaaaacaatcatactactaaattatgtaagggtaaaaaaatcaactggagaaggtgaaagtttctaacatttatctgtgcacaactcaggctgacactttgaagagaagaatgtgacagcttacaagaaaacaaactcactcattccccttaatttctgaaggctcatgaaagtctgacaggccagccacagggtgatctctcatgtgtatcgcccatgacaattatggcttcaataaaaatggtctctatttttaataaactccaactggttttcaggaaatagccaggctaacatggtcatatttaagaaggcatatttcaccaattagcagctaacttatttagttcatggacctaaataagactgtgcatggagaggtacaaaatcagtgtggtagcagagggcaaggtggtgtgaaaggctgagtccaggggtcagctgtggtgacacatacaaatggctgtgctgaggatcaccttgcccctctactttcttttggtttgatttggttttcctctttaaacagctattaagagtctccctatgaattttcaaagtgtttatgactcaaatctgggaaatactgataaaaatcacagctcattataagcatttgaaatgatttgccctaacgatagataaatgaaatataacgagtttttaaagtactctgtaattcacactggaaataacctgcagttgtccttatattaatttgacagttgcttaatatgaaataatcgggctgctatacagacactttgtttcctccccatcaaggattgccagcagaagggggaaaagaggaaaagaagtgctaagcaatgaaacctcctttcatttttagtctccactcctatggcccagctcttatcagctagtgcaggacgaaggaggaggaatgaagggagaaagagtcctcctgccaattctcaccacaaccctacttccaatctctcctaagcactgctgtgtttctagtgacagaaatctgcattagtttttcacttcagaaaacaagccatcagaggtttaaaattcacagactttctggatgtggtggaaatttccccatcatgactcctaattccaaataattaacaactagtctgggaacacaatcagtttaggaagaagatcttcatccaattcttgaaacaaaatatgcctctaatcaaaaacagtcacactattttcctacacaaacttcattaaacatgaagaatagaattgtgtaggtttataaaacatgaaggaagttcttctttaaacagtatttattgcacaatcatatcgattttcatgctaataataaacagcagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcatctctggtgtttctgttatctctcacagtgagaaataaagaataaataagaagaaaataatttttttaaaacaaatatcacaaaggattaatattcttaatatatagtctctataaaatttagtatgaaaaaaggaatctaaaaggaaatgcatgaattataaaaaaagagaacttctagattcagctccaatacataaaaggcctggaaatcatctctcccatccttacaacaagaaaaagctagaacactgaaaatcaaccagtgttccaggacctgttggagactcaagggctcagggcaaacctccacctggaaacctggagagttcagcagtctggagtcctagttgggctcagctcacctcgagcagaagccactagaaccacagactggtgggaacacttaggtggtattttgaggaattgctgggaactgagtgtggagtagaacaaaaatgagaaactctagagggctgcagtcttagaggggtcctcattttcatgggccttaagtctaggagccccacaaggtggccatggtgaagatctgagaaagatccccttgtacatcttgcagaggacagggaagtgactttctaccaaaaatacaggatggcaaaggatttttttaaaagagtaactttacagtggagaaacctggcaaacactacttgggccaggtggtcaaggtcactgtcaacagtgataagtcatgtggatagcatgttccctcgatatggtgtgatgataatggcactttactgttgtgggcttcctcccaagaacccagaccctagcacaatcatgagaaaaacatcggacataccccaactgtgggacattctacagaattcctgatcagcactccttaaaactgtcaaggtcatcaaaaataaggaaaacctaagaaacctttacagtcaagagggcctaaagagacatgaagacaaaatgtcatgtggtatcctggataggatgggaacttggaacagaaaagggacgttaagtgaaaattaaggaaatctgaatcaagtatagacttgagttaatggtaatgaatcactgctggttcattagttgtagaaaatgtgccacactaatgtaagttgttaacaataggaaaaacagggtgtagagtacatgggaacttggtaccagcttcacaataattctataaatctagaactgttataaaattaaacgtttatttttaaagtaagaaaaacatgcagtatctgaataatcaaataaatataaattaaaagtaagaggtgtaactttttttcatcaacacattcatcaaaacttgaagttcaatagtaatcaatcctggcttaggtacaataaaacatactttcctggattgctgtcagttagtataatgatttagaaagcaagctttgcaatacagttcaaaaacacactaactcagtaactctatttgtaagcatctattttaataaaataatcagaaagcagataaatgattacgtataaaattttgcatatttgcctcattaaaaattgtaaaaataagtaaaactgaaaaactaggaaaaagacatcatagcaattggtatgggagatactgccccactgggaatcatataaaagccaggctgaacacagaaaacaactgtttcctgagtttgggcagcagacaccccctggtgtggtctctgaaagaagagctcacccgagtgggtaccacctccagattggctttccccaaggatgcccttcaaagtgtaacccatggagatagagccagggagagacagtctgcttgatcaccatgcagggctcaaaattgttcaatatttgaaaatctgtcaaggaaatattttcaattagcaagttaaagaagaaaattcataggatcatttttaaagacgtgggaaatgcatttgaaaaaaatcaaaacccatttataataataactttgagctgaacaagaatggaagagaaattctttagggatgggtatatgctgaagacgctatcaaataatgcactgaaaggtgaatggttgctgtattaccactaaaggaagaaggaaggaaaagaatgtctctccccatcaccaccattaaatactcaacatatattgaaatgttcgtcaaggcaataacaccagaaatgtttacaagagatatgatattggagcaaaagatctaacgctgacaacattagcagataataccattacctaggaagtccaagggatttgtctttaaaacatactataaccaataagacgttcagtaacatctccagtaacacctgtgtgaataaaattatgacttcaattaaaaaaggaaacccaaataaatagatgtgctgtgtttctaaaggaaagacttgatattgtgaagatatacattctcccataattaacctatacatttttgagccattccaataaaaatccaaacttactatctacaaaatatgagaagctaacccaaatttcacctgagtgtgtaaaccagccagggttacagcaaattctagagcaggggagtgagtcaacaatggggcaccagatcactagatatcaaaagataaaccacaagaatcaaaacagaacagaattagccaaggaaaagacaaatcagtgaaatagaatacacagcccagaaaaaaaatattttaattcaatgactaaggaataatgaaatagctggcataggcataattgggatccacctgtgtgtcagatcaaggatggctccagagtctagatatgcctgccatcaagaggtggggtctctgcctcctccctttgaatctgggctggattttagttgctttagagtatgttggaagtgatactgtgccagctccagtccaagtctttaaggcaacagcagattctgtttcctttctctggtagccctgtgctgtcctgtgggaagtctgattgtcctgagttggccatgctgtgaggaagcccaggcttgccattggtggggggccatggggagggagaaaggggaagttgaggggccagcccatgactccttcctcctccatcccagctgagtgccccaacattgtggaccaaaagcaagtcattgctgctgtgccctgtcccaattcttaatccacagaatcatgtgaagtaatggttgtaaattattggcttgagggtaaaccaaattaggggatagtttgtcatgcagtaatagctaaccagaacaacttaggggaaaaataagttagactctctttctacactataaataagttccaaagggatttaaatatataacttacaaagcaataaagtactagaataaaactaagaagactgatagtttaccttgctaggaggtgtagaaaaggcaatttcatacattgttagtggtagtgtgaattgctacaactttttggagagtgatacacaatatctattaaaattatcaattctgagaatctagctatggaaaccaagttcaagttcttatcaatatataagactctctgtaagaagatgcctatcacagcatagttataaaaaaaacaatgaaacagtttggatggtggaatcaattgcatcctatccacacaatggaatgttatggagctattaaaaacaaaaatgctagatctatgcttatgaacctggagggattttgtcttattcagtttgggctgctataacaaatataccccatagatgggtgttttaaacaacacacacttgtttctcacatttctagaagctggaaagtccaagatcaaggtgctggtagatgtggtgtctggtaagattagacagacaccttctcattgtatcctcgcacggccaagagaaaaatctctctcctcataagggtcctaatcctattcctgatggctcaaccttcatgatctaactacttccccaaagccccacctcctgagaccatcacactggaagtttgaatttcagcatatgaattttggggagatacaaacatttagtccaaaacagatctcaaaaattaatttaaaagtagtttcacactctggaagatgatttggcaagttgttaacaaataaacatgcaattatcatatgacccggaaacttcattcttggattttttttcctgagagaaataaaacttgtgttatcacaaaaacttgtacacaaaggttcataaaagctttattcaaaatagccctaaaatgaaagccaggctagatgtcctttaacaggagaatactaaacaaactgatgaatccatggaatgctactaaacaatgaaaaggaacgaaatattaatacacacagtaaataacctggatgagtcagcaaagaattgtgctgaatgaaaaaagccagtcccaaaagattatatactgtatgctccatctgcacgacattttgaaataacgaagctgtagaaatagagaacagattaatggttgttggggattagagattggaggaaggtggacgaatgtgtgtgtgaggaaggggacaagaagaaggtgaggagtaatgaaaaggcaacaagagggtccctatggtgatgaattgttctgtatcttgactgtgatggtggccacaggagcctacacatgtaatgaagtagtgcagaaatacacgtgtgcgtgcgcgtgcacacacacacacacacacacacaagagtacaagtaaaaccagggataacatcaatggattgcatcactgtcactatcctagatgtaattttctactacagcttcacacaatgttatcctcggaggaaactaggtaaagatacacaagaactctatattatttttcacaacttggaagtgaatctatagttaaccaaataaaaatctaaattaaaaaccttttaaaaatattataacaaaatctataatacagtaaaaaagtagctttcagaggtatttaaatatcatcttcccattttggtaaaacaagacaaaatgaaacttcatatatttgaatatatatttgaatgagcacaaggtgtgatagacagagctcaaactattaacactggttacctatggaagccgggatggaggagaaaagaaatgacattatcaagttatcaagatgacattatcgacatattctatgttgacttttttttgctacattaggatgcatttttataataaaaataaatattggaaagagctaaatgaaaaaacaaaaccataaaagtgatagggaaaataatatattatttttacaagtttagggtggagattccctttccaaggaaggaagattcaacacccagaagccataaaggaaacaactaacagattcatctcataaaaaaataaaaactcccacagatcaaaacacatcataaagaaagtttaaaaacaagtaacgtggaattttctaacaaacgaaagattagtagccaaaaattgtccttacaaatcacaaagagaaaacaatgaaatagaaaaattggtgaagactttggccagaccactaggataaagcaataatgttgactgctaaaacagaaatctttcagccttggtttggcctgagactctgaaagtcaagaacaagacagcaggtgccaactagccccagcgtctacatgctggaccccgatgcaagacctgctcagaggatgatctaaccctccacctcttacccaaaggagaggcagagggagacagggcttcttgtgaagagttggcagtggcccccgaggttccttggagacacacatgggcacacacacgcatgcacactcagacacacacggaggaggaaggcaatctgcttctcagcccatgccagagggcagtcacactgtgagaggaactccaagatgggtcaccaggagaatgtgacatgcgtccctccaaagactgaaggtgagggtacgtggctatgtctgctctgcccaagctggcacaaggggaagcaaaggacagtgaagagaggggaaggacctagggcatctaggccccaaattacaggctgatggtggcactacgagtggccccagtgaaaggccttccctctgtcaagaaaaggacaatctgggtccacagtggattgggccttcatcagcccccaaagcatcattcaaagagagcatcagaaattgcacccagaagtctgaaaaaccccaagctgtatgacatcagccactttgtggccttttttcctaatcctttctccttcctgagtccagcttaagaaggataataagcagttcctgttgagttgggggaaaagaagggtgagaacagctgagtttctctaggcagctcctgctggaggctggggaagctttcactgggatgagagcccagagtcagatttacgctggtcctgactgtgctgtgcggtcctgacagtgctgtgcgatcctagactgaccgactagactgagccactgaaaatttagtgggagttgccccagattttattgaacagcagggaaggaaaaccaggagagcagattggaaagggcaatagtgagaactacagaagcggtcctccacttggcccccggtgaagtcccctggatcctgtccagaaaggtcctcctcaccagcaatcaaaaaaacacaaattaagacaaaaatatgtttctctcgattcagaggggcaaatatgcaacatgccaatgtggtctcaggatggtgaggaaattgctcatgcatcactgaagagcctgggagtgcaaaaactccctccagaaggcaaaatgcagatttgctgaaactaaacttacactttacaaaaatcccacttctaggaatatgttctaaaacatctcttgtatgtgcataaagttgaatatagattcattgcctcattagaaaagtgcaaatttagaacaatctacgtttccatcaataagggtggctaaacaatcatatgaagaaagctctacatcactgatcattacagaaatgcaaatcaaaaccacaatgagataccatctcacaccagtaagaatggctattaaaaacaaaaaagaaaacagatgctggctaggctgtggggaaaaaggaacgcttatacactgttggtgggagtataaattagttcaaccaatgttgaagataatgtgacaattcctcaaagacctaaacaaagaaataccattcaacccagcaatctcattacagggtgtatgcccagagcaatataaataattctgttataaaggcacatgcacatgtatgttcattgcagcactatccacaatagcaaaaacatggaatcaatccaaatggccatcaaatggtagactggataaagaaaatgtggtacgtatataccatggaatactctgaagccataaacaagaaggagatcatgtcctttgcagggacatagatggagctggaggtcattatcctaagcaaactaatgcaggaacagaaaaccaaatactgcatgttctcacttataagtgggaggtaaataatgagaacacatggacacatagaagggaacaacacacactgggcctgtcagagggtcggagggaagagggagaggatcaagaaaaataactaatggatactaggcttaccacaagggtaatgaaatgatctgtacaacaaacccccatgacacatgtttacctatgcaacaaacctgtacattctgcacttgtactcctgaacttaaaagttaaaaacacacacacacacaaacaaaacacgatgactgcatacacacacagaataagatgcagctggtaaaaagaatggctctatcttctgatataaaaaagtctccaagacacaggaagtggcaaaagcaaatcacagaattgtatccaatgtatgacactccttacattaaaaagcaaatataggccggccacagtgacttacgcctgtaatcccagcacttttgggagggcggatcatgaggtcaggagatcaagaccatcctggctaacacggtgaaaccccgtctctactaaaaaatacaaaaaattagcccggcgtggtggcgggcccctgtagtcccagctacttgggaggctgaggcaagagaatggcgtgaaccccggaggtggagcttgaagtgagcgaagatcatgccactgcactccagcctgggtgacagagcaagactccgtctcaaacaaaacaaaaaaaaaagcaaatatatatgtatgcgtgtgtgtatgtatttatatattcatacatatataaatatgtaaaaaataattagagaattctcatcaaaatgttgccagtggttacctctgggaaggtagtggttacctttgggagggtagtgggtacatgtgaggagaggttttttgtttttttgtgttttttggagacagggtctcagtctgtcacccaggctggagtgcagtggtgtgatctcagctcactgcaacctctgcctcctgggttcaagtgattctcgtgcctcagccgcctgagtagctgggattacaggcatgtgccaccatgcccagctcatttttttgtatttttagtagagacagggtttcaccatgttagccaggcaagtcttgaactcccaaccccaaatgatccacctgcctcagtctcccaaagtgctgggaccacaggtgtgagccaccacacccgcctcacgttttttattgagtaaacttcactgctatatgaatcttttgtaatgacaatgtatttatatatgtgtatggtcaatgttaataaaggttagagaagttaaaaatgaagaaagagtactgtggaggatggagtggatgaagggaaaagccaatcagagaagcaccctagggtgctgtagcagtagtccaggggacacctgtgaaggctggaattagacatgggcacgggaggagaagggggagcaggtgagcatgggcttaagaggacaactggcacagtttgttgactgtggacatgcgggctgagaggaagaaaatagattaatgtgatgactaatgtagctgatgacaactgtcccacacttcgagcaggggcccagggcaaggagcagggtggggaaggaagcagaggtgagagttcatatcccaggggatacacttctggcccatcagacagtggagtgtgtgggcacacacctcaggcggcagatcttggagattccaatttgtatttctgaacatgtaagtggctttgagcatgatcaaggtgaacaagaatagaaatatggaaggcaccaacagatgatggacagatgaggaaggagatgataactacagcaaaaaggccaaccacaggagaggctgccatttgttgagcaagtgagatatgctgtgtgctgtccctttattttattcaatcattataataatgggaggtgggttttatcatgattcccattttataaatgagcaattggaagcttagaatcaccaaataattttcccaacatagcaaagaatccagctctggctgactccacactcacagcaactacaccacttcgcttctgccgaagcaatcctacttgcactcctccttttggattgctgagaagcatcactatctaattaccataaagccccctcctctccatgcctgctatctttgtcctggtttgagacctctttatccctcccatccctaccttcagtctatcctgcacaggactgacaaagtcatcttccagaatcacaagcatgactacatcagtattctacttaaaatccttcagtaagtattctctctaccagtcgagatgctcgagcaaggaacagagagatactattgtctgaaacaaccacaaagacaacaaaacacatgaaacaatgggtttcttttttatttgtttttgtttttcagcttatattttagattcaggggtaaggaaggattttacctgaagccttagcgggagcatggaccttgagaccttgagtttggacttccagccttcagaactgagagggaatgcattcctgttgtcttaagccacgcagtttatgattctttgtgacagcagccctaggaaactattacaataggtttatagatttcatcagacttggaaaatatttgaccattagttcttcagttctttttctttctcaccctctcttttgctcctctgaggactcaaatgacctgtaaattaggccactttaaattgtcccacagttcactgatgctctgggagtcttttaaagacttttttttttttttttgagatggagcgtcactcttgtcacccaggctggagtgccgtggtgcaatcgcggctcactgcaacctctgcctcccaggttcaagtgattctcctgcctcagcctcccaagtagctgggattacaagtgcctgccaccacacccagctaatttttgtatttttagtagagatggggatttcaccatgttggccaggctgatcttgaactcctgacctcaagtgatccaccccttcttggcctcccaaagtgttgggattgcaggcctggaccactgcacctggcccaaagactttttaaaattttctttctgtgatttctattgctacgtcttcaagatcaccagtctcttgtgatgcctaatctgatattaactccatcgtgtgtattttaaatcttatatattgtcttttgtttggatcttttaaatatcttccatgtctgtacttaactttttgaacatgtggaatgcagttataataacagttttactgtccatgtttactaattgtaacatccatgtcagttttgcatcagtttcaattgattaactgtctctcattatgggttgcatttttttgcttctttttttattcactgctagacattatgaattttaccttgtttggtgctagctacttttgtaatcctatgcatattcttgagctttttatatgcagttgaattaactgaaaatcgtttgatcccttcaagtcttgctttcaaattttattaggcaggacaagagctgggtttagtgtaggactaatgatagccacactcatgaggcaagaccttttgagtactcaatgcccatgaattgggaagttctccagtctgtctggtggagacaggtgttgttcctggcagcactccattctctgcctttgtcatcacatgatgtttgtgtctcctcttcttgtgtacaagaacaccagtcatatcaaattagggttctccctaatgacctcattttaactggagaaaccttaactgattgctttctgcagccaaccagaggtaccttcaattttccatttgccacagagaaaaggggaaagatttgcaaagggagcagccttgagtccttttgttactgaggcatggaaagttggggttttcctctcaatttagttctaggaagtcagtgtgaattgatcttagattccctgcctccagaccctgttctcctgcctcaataggagagaaaagctacaacaataagtgaatccgcccaggagatccataattgaaaaagttttagaaaagagaacagagaaagtatatggagtgggggtcagtaattaaagaaaacaataaaataaaatgtatcagattttgcataatgatcatcagcctctagtgtgaaaagacccactgaataacccctaagtgaaatgagatccacgccaaccagagcactccccggataaaagagaaaatcccgaaatatttcagagagggatctggccttgtatgaaagaagaggggtgagaacggtgtctgacttctggtggcagctctgtgagccagaagttagtggccatggcttcaaattctaggtcaagaatctccgaccaagctgccaatcaaacatgaaggtagaataactaatttttgcacatacaagctctcaaaacatttcccagtacaaaacattcttcagaaagctatagagagggaaaaaaacaagagaggacccatctttcagcaactagagacccagcgcagggaaggcaaaggggactcccagaaccccaagacaaccgttggaccaccacgtgtgctggggcaggggcctgggaggatgtcgctaggagaggaagcccagccatgatgcatctgcaccactgcaaagagagcccccttctggcccagagtctagggatgagtgggaagacagcactaaaccaagggaaatcttggcaactgtttattccaagtaaaacaaaaagttgtacaaaataggaaatgtgcactgcatggtttagctgtgaataatacgaacatagtcataactatgtaaataccaaatattgatttggccaaaaattaggctgtaactaccatgatggggttgagacaaacagagagacagcacgtatgcacaggaggatggtgtttttaaagagcgacatcctcctcttccatggtggaagttcatcccgtgacatttaaactggaaaatcaagaaatggccttctaaacttgttattttaaagtcaggaggaaagcaccagaagaaacggcaggaattcaaagtgattgcctctggggaacgggaatctggagtgggaagaggaacgctgtttctcattacaaaccttgaagaaccatttaagttttaaaactacatacatatatgactctgataaacatacatttttaaaactacttacaaaacagcaaggaaaagattaagaagggtgaaggcagcacatttcagactgtttcagcgacttacctccaagtgagtaaatacataactcagtctatgccatttaggcatagacctaaaggggtggcatccagaaatttcttcaaagtcttacttattatctttaaaattcaggcagaagtttttactctctttcataatacatccctgtttgtttttatagtatgtggcatacctggcagaaggttttcttttcctctccttttgccttctttctctttcctgagacacacatcaggctgggatgacagagaaagacattctttcagtagaataaggtatagagggtgcccgtaggattaactgggaagggtgaaatatctgataatttttcagtcattacggactagtactaccaaggccccttatagcatctgctcaccccactgtctaagcctggtgtctctgagcagggaactcagggagcttgaagactggacccccagcacaaggccagggtgggaccctcttgggatcaggcggcagacaaagccctggaggaggggaaggagatggagtccaagaaggaaaagacatctcagtcttagcatcagaaagaccatggggttgctcccaaagagttagacctaaagccccacagcagagaaggaatctgggaaggtgggcttcaaggaagaaagtggagaatcccatcccaattctccaactcctcttgtgaattctggaatcagtacagttgttatactcacagcaaacatcgttcagggtcttcttgcacaacagagctttcaaaaatatgctgtgatttcatcagtttcctttattggccactgatatgcaaagtctatcctgaggctcaggatcccccaagttctcccaaagaccctcgggccccagtctaggaagcatggagatgacaagtggaaaacagtggcatcacacatgggacagatgatgtgaagttggcaggaaaattccctgggatacgacttttgtgggggtctctccacgtcctgccctgttggaggctggaagcctctgtgctctctacctcctgggggggcagcagggcagaaaacagaaggttctcagagagtacccctgttcctagctcttgttcttcaaacgtcaggaagtgtgttgggaagaagaaagaagttagctgcagaagccgggagggaaagaggaaagattgtgcagccatcgagggaggcaaagtccatggctcctggaggagagaccctgcctggctagctgtcggtgctgaggaaagcaacttctgaaagcaactgctagagggaggcatggaatttccactcctgtgcaggttgctgtgaccttggggtccagatgcacggtgcccctggccttgaggagaccaggtaggctgtgttctccacattatagccctaacgggtgggttggaggacttgcttgctgctcttgtgggaccttcataagcccaggattcaaaaggaaccttcaatataactgagactgaattatttccagccaggcagaagtgccagaaattcaaagagtatttgggaagcaaggcatatgcctgccgcttaagttattcttgttgttttgaattatgaactcctttgcttcaggtgatgccccatctggcctggcatccaaggcaggtgagaatttcctccaccaggctttgcttggcctgggatgaggaattcgactggaatcacactcactccaccttcccacatccagacacaagcagtcacctttagggttttgcctctctctgttccagacagctggttccagagtcagctgtcacaactgaccctgacagctctagggagaattagcaaggcagaggaagggagtccttggacagagaggagggtggacaaggaagagaggagactttagagacaggcacatcccacaacctccggtgttaccatatccagcaggctgactgagccgcactgagccctgggcagaagtgggtgatctctgagctggggctgggtttcatttttcttgtctctctgagctcagccaccaggcgatacccaagttagtataccccacccacactgtggccgtgtcccagtgctccaaacgccacattgaagggagctggtctcagactgcagagctcacatgtgacagacataaccaatggggaagaaagagtcgtcccctcatgagtctgaagccagtacctaaaggagagaatggggaggcggcaaggcatggccccacagcagaggtcggaaggaagagctcccagggttaagaagcgaagccccgagacacagccaccattcccaccaccccagctcagggctacctttgggacccacccaaaactcagctaaggccagggaggaggggtcctcaaggacaagctgcaggcaccaagccctgccatcaggcactggccagactggagtgagaagccctgtgagcacatactcgctcctctacttgttggtcttggttttacgtgtcaaccgaggaaacagggccagtgtgtgcaatcgcctatggttggaggcgtggtggaaggcgagccccttctccccaggctttctgaaaccatgtgggagatctctaccagagtgacactgcctgcctcccatccccaccccccactgctggtggcgatgggacagtccagagtcctagtttgggtaggacagaaccatagaaaggcaaccccccactccggagtctcattccctcctctctgggtcactttgacagtcttgcctgctccagcattctctcggggctgtcggaaaagtgacagggagtgggcacagggttagggaggtgagtgtgggcctgctgctccatcggcagtgccgtgaggaagctgctgctccttctccagttctccatctcctgcatttcacttctcagctagatgtaagtggagaagaggaataatggggtgttatttatgagtcccttaaaacctcaacaaccctaccatgtgtcagacgaggtgcctggagctttgtcaatccctcgtgtcattttgtgccataactctccaggcgggaattatcaccctgtgcatgtgagcctcagtctctgccattcccacccctgcgctctttcctccacactgcaaagtccccatcggtaggagtacacttgtctctcagggcttgggtgagaagccctgggaacctcatttggtgggaagcttttgtcagctgcagagcatcaagcaagccttgggctctagattttgctgtgcctcgcattgctgataatccaatggtgtcttgcctccagctcccgaagtccacagatgtggcagcgatcatggccctgttccctgctctcctcagcccacacgttccccttagatgacttcatcggccacaaggctccaattaccggctctctgctcagatttatgtctcccgcccaggctgtgtgcagggatccaggtgcacacatccaatcctgtgcacacctccctcagccgtctgacagctgccgaagctcccaggtctacatccacttgacatctgcttctccagatctgctcctccagggtcctccagaacatggtactgtccttagacactggcccctctctcaacacccgtgtccaatcaggctctgagtcagggtaggtcaaactgagaactcctggccctgttcacatctctctctgcaaaggccaacatggtttctttgcccgggttatgtgctagcacctaaactagtcttccattcccaccttggccccatcaaatccattctgtgtactacccaatataatagttcttagacacaaatctgatcatgtcacacagtcgtttaaagcccttcaaatcctcccagtgcatttggagggaaactggatggctgacgggggcccaggcactacagggctggcttctgccccttcttcagaactccagccacagaagtctcctttttgttctcagaagcaccggctctttcccatcaaggctcccacacgtgtgtccctctgcacggcctctcattcccacactttgctcagccaactgcggccaccttcagtctcagatggcattagatggcacttctgcagggaagcccatcgccctccagattgacctgagaccccccgctctctggaatacaggaagactgaaaaaaccttactgtgttttgaactgtaatgtgctgtttacacttgtgtaatgactttcttccgtgagggattatggtgccttgaatacagaaatcagggcagcctgtttctcaactgtgtcctcagggccttgggcaggtctagcatgaagcagggattagtaaacatcaatggaatagattccatggaagaggctattaaaataagttgcaaaatactgaatatattggtttttttagtcaactataattttagagcacctgtaggttcacagcaaaaactacagagatttcccttataccctctgccccacacatgcaccgcctcccccattatcaacatctcccgccagagtggtgcatttgttacaattgatgagcctacagtgacacaccagtatcacccagagtccatgattaatttgagtttactcttggtgttgcacattttatgggggttaataatgtcatgtatccaccattgtgtcaagtgagggaagagggccagtgtgtgccatcacctatcattggaggcatggtggaggatgagccccttctcaggctttctgaggccacgtggggagacctccaccagagtgacactgcctgcctcccatccccaccccccactgatggtggtgacagcacggtccacagtcctagtttgggtggaacagggccatagaaaggcagcagctccccaccccgaagtctcattccctcctttctgggtgagtttgacagtcctgccatccccggcactctctcaatggtatccacatcgtagtatcacacagaatagcttcatggccctaaaaaacctctgtgctctgccgatgcacccctctgtccccccaacccctggcaaccactgatcttttaattgtctccatagttttgccttttccagaatgtcatatagttagaatcatacagtgtgtagccttttcagagtggcctttttcacttagcaatatgcatttaagtttcccccatgtctttccatgtcttgacagctcattgctttttagcactgaatcatattccatgtgcctggatgtgccacagtttatccattcacctactgaaggacaatttgatgcttccaagttttggcagttatgaagaaaactgcaataaacattagttttgggggtgctggttgtgtggacataagttttcaactctttggggaaaatgccaaggagtgtgactgctggatcctatggtaagagtatgcttagtttttaaagaaatgtcaaactgtcttccaaaggaaactgtaccacgtttcattcccaccaacaaatgagagcattgttgcttcacatcctcccaacattggtgtttcccgggctttggattgtgttcattgtactggtatatagttggatcctgttttaatttgcaactccataatgacatatgacattgagcatctattcaaacacttatttgccaacttgtatcttctttggtgaggtgtccgttcacgtcttttgcccattttttaaatcaggttgttcgttttcttattgagtttaagagttacttgtatattttaggtgatagtcctttgtaagatgtgtttttttcaaatttttctcccagtctgtggtttgttttctcactatttcgaattatattgacttgacttaaggacaaaaacaaccctattttaaagagtttgtaatgagaatgagtacagcaccttcttcctagatctagaagcagtgcacagctgtggtttcctaggctttcctggccattagatgtgggtttgtcaggagcccacactggcctgctaagctgtggccactagtcccacgtctcctgggctagctgtactcttttgaagccagtgcctagactaatgctttggggtagaaaggccgaaagtcctctcactagagactccacctgacaggcctctctctccagggaggaggtggtggtgcctcaaagaagaggaattcccactcttggtcattctagcaagggacaggaaatgagattagtgactgggtgaggcacagggacttatttggagcattctcagggaaggggaaggcaatcttactccctgacagtgagggaggtcatgggagaggcagccaggaagcccccttgttccggtccagggagctcacccctgacagaggcagctgagagttgatatgcctgggttgatgactcttgcacccatttaatttaaaggataaaggtaggctgcagtgctttggggccaggccacttggttttgtgctcctttcaggttttttccacggggactgttgtgcatctcacagcactccacgtgcctaagactgcaattgtgggtgcatgaggaagacagagcccctccaactcttcctgcccagccgttggtgagaacagagccagagctggagctgcaggagaccttggtgcagtgcccagtgcacactgccctacctgacaattctgttgggatctgggggacagccaggatccagaggggctggaggaacagaacaaggccctggacataggctggccacagagcaagcgcagccaaagaggaagtgctgtgcctggtttctttccgccctccctcctccttcttccctgttaactgttctgctgggagcctccggatcatggattagggattgtggtgggaccctgtcagactcaccatgttgaagcaggtcaccaaaggtcacacagttgcccaggatgagaatgcctgtgcccaggggtgcatcaggtagagtgaggagctgggattggatcccttggccaggctgctgcttctgcaattatccagctaccgtaggacaggaataaaagaagccacagaaatcaaagagctgaggtaagcaggaaggcagggcgagaagggagggcccaaaacagcctttccccaaaacagactttgctcatgatgatgggaactgtcgagtcttttgagggaccaaaagggggacacagtagcagagctgaagggccttgtcctccaggaatcaggaaggaaaggaaactaaggcagccagagtttatgggtcagtgctgggccccaaagcccaaccgtgcaaagggttttggctccacctccagcaaaatgatgtctgatgatgtgtcccaggatggggtctctgccagccctcctactcattgatgctcaccctgcacccagaaccactcaagaagcagcgggggtgggatgaacctccaggatgcctgcaggtggggcagattcaggggtgaaattcagaactgatataagaaatagatttaccttgaagctaatgatgcttccagcacaggcctctcatttgtaggaaccccttccaaagccccaggagtggctctagcaatcaatgtaagtaagaagataacctctcattctactgggacctcccctgtgtcccacacaatgcactctgcccccatcaggtggcactggagtggccccaggcatatgggggatccagagaggttcagctgagaatatgttatttaatctataatctggaaagatgctttgaaaagttgcaataaaacaaatgagaagttatggtcttccactttggacagaaatatgattttgtcatccttaaatttttaattaaggaacagagaaaaaaattagataatgattaatggggccaggcatggtggctctcacctttaatctaagcactttgggaggctgaggtgggaagatcacttgagctcagaatgttgaggctacagtgagctatgatcacaccactacactccagccagggtgacagagcaagaccctgtctcaaaaaaaaaaaaaaaaaggaaaggaaaaaagaaagaaagaatttactgttaataaaattatgtttttaaatgttcatattttaccatgaagaagtagaaataaatgcctaataaaaataataatcaggctcttggaatatttagtaatctaatcaagagaagtgagtcctatgaagacattggggaaacttttaaatttattgatgaattaatcaaaactgacaaaaacaaagaagacactaaacatgaataccattaaaatgtgggtctagaagtgtatttgtcattcagagagcatttcaggtcagtcaccatacagaaaatttgacatgccctaaagtcatacagctcagatgggatagaaacatggttcaagtcttccctaattttttcaacaatttattataatttatatgacattatcaattcatcatgaagttgaaataaatttttctcaactaccgattttttcagaaaatgttgtttgaccagcactgccagaggaaagactgaaattacctttctattatgactctagaaaatcattgtcatatgaagagggaaacagcaagtacctagccaaaaatacaagaaggaaaatattacacagtatgtctggaagccagtaaataatatgtttttgcagagttttgtgatgtttacattatttatcagcttttaaaaaatgtgtagttcattttaattcttgtatcattttgaataagtattcacttttacacctagttttgtactcacaattttgttatcctttttctttacaaagtcccctacatttaatatggaatcgtagaaactagatggactgtgacagaggtggtgaccaggcatgggtgcagacacaaactctgcacggcctcagtcaccttagcccagaagccacctctaggccctgggacaaagagccaacctaaccacccgcaggcgtgcagccctactggcaggcactagctctccatcccccgacacctccccatggctcaggcgcccctgattcaaatggggaatggactggcatctggtcactagatatctcgtccccagattaacttttgagtcatttccaatcctgttcttttttaaagactgatggtgtgtactttcacactcctggaaagcaaataacatgagtttctggaggacaaactggcaatacatattcaaagtattcatactctttggcctggcaatcccccttacaggaatctatgaataggaatgatcagaaaaacagacaaatatgtaagcaaaataaggttcccacagcattgcatgacacaataccaacagtgttaacagaaagaaaatccttctgttatgtctctcccttgtcactaggtatccacagcctgaagaaatttaccaacatattaactaaaatgctctgagtggtacaattcggaggatggttgttttcttctttatgcattttgtgtgtgtgtgtaacacagatgagtttatcagaagaaaatgcacttttaaaatgaaacagtcgtagaaggaaatcaatcagacacctaaattaggaggctgacacaactgctcccaaaggaatgtcttagtacccctcagtatttctttaaaataaatggcttcagaaggctaaaaaatgggcctgcccacctcttttctcagggatccctagagcctttgctcagacactttgattcagtaatgctcataaatatggagcggccctttgcaagatcccttgcattttaatgtgggggtagtgctcacctcctccgtggatgggtgattgcaagcagtttcttggtcctcatttctgcaagagccagtgaggtgtgtggactgggatacttaagaaggagacacatggaaatgccatcttctgaccagggagtcccttggaccttggaagcaaccagagagcagagaaagaacagtagcccatgcagatgaacttacctccctcttctggccttgctgttgtcttctgtcaagtggggagatgactctgagtaatctctgagggctctccaattctgcacatgagcttcctacgagcagggaagttgactggcatggtggctcatgtgaaggccatggggaggacagggagttcacccgatccagcgcggatgcccttccttcatcttagcttgggcgggttagtatttctcatcctgaagtcaagctacctattctggtctcctggagtctcttctgacacaaggctaagttatgtaaatacacaaactaaacatgctttgcaggcataattttttaaacagagatgaggaatagagaaataaccaaaaaaattatgtacctttctgtgcctggtttatgtctgatttcacagaatccagcagactgtatacacatgggacaagcctgtgaacttggctatcacctctgagtttcagagggtgggtgacagacaaagacaggctggcgccacaacccagcacagcctgcagaggacacctacacatggggactcggtgtgggtcttggtggcacaggggagtctacattggccaggggagccctggggcccaatctcaggaagggatgtgccgcagggaaaatggagggccagaggagatcaaggtagagatttgtttctgtgtacggtgcagagagaggtccccaggtacaagccaagatgtcacaagtgcagggtgggtgaaaggcatctcagaggccacctgcagggaaggatccctactgacctgggcacctgaacacagtgtagcctgcaaacccgtcctccccagaggctctgcacccacacactctctgatctccctcatctggacttttataccaaagaggttttgatgcgcctatcagcttgccaaggccactgacagccacagaaatgcggtggagccaaccccatccaggggtcagtctttgatcctatttattatttagaccagtttgtgacttggtcaatacagatgctgcatagccaggaagcactgggtgcaggcttcgagctcattcccacagatttagtggtcagagaggaaagggcaacaccttggagaagcttgggaaattgaggcccaagagatgaagtccaggggattaactcgctcagcctcaactggcaaaatcaaatttggaagcagctagaaaaccacattgtgaataatgtagtctggcttggccccccacattgccttgtcgtgggcttccaaaccatccacttggaagtgccccatcaccagcctctaatgaaatgcaattggtgttcccgaccacgttcctaccttcaccagtcccagcagcccctcagtcccggccgcacacacttgggcacgccatgccagctgcaccaagccaatctgctgtgagatgccgggaaacggtttgcaaatattactttccaaatttatcacacttggcctggtaccgtggaaaaagttggttttgattttactgtggatgatcctgaggccccagtctgtgtcctactggggctggcttcgggtgctggggccgaagcctggtctcagagaggggccgggccttctcaagtggttctgctgccgagaaaggtgccagcccctccactgaccactggccacctgcagaagcccacctggctacactggccctttcctggcactttccaagccagcgaaggtgacctccctctggcaaacagaaatctgcgctgttgggagacagagcagtaggcatctatctccacatagctatcttgagcacctggtatgcaccattttgttagcatggaactctctccctatccctatctcagcagcttccttggagccagcagcaggcctgaggaggaggagaggggagtggccatccagctgtcaagatagaatccacaggccccataggagggacctggctgcccatcatagacactcagtctctcgctctgtggctgtcaagctcccaatatttctgtctctctcttcttttctgtctttatctgtatctttctctgtgtcttcttctctctctgtctctgtctccctctctgtttatccttctctatatctctgtctctgtctgtctctgtctctctctccctctttccctcctctccctctctttttctctctccttcctccccctttccttgcatttccctggggatgatggagttttcctccacgtcaccatgtggctagacaaatcagccctggcctttttgctcttgcatgagagtagaaggcctcccaaagcccctcaggttccatggtgtctgctccagccaggccccccaccaaaaccctctgaatcactggctctggggatggcaagagccctctttccctggtcctcacactcagtcccagactgttgagactaatgaccttgagtgtgtgtcacgtccctcatgtccccctctagggaaactggccagagtgggaaatcacagccagattttgggtcatgggcaaggggctgagggctcatgtctgtgaagagaggggcctcgaggggcccaggcagggaatggcagtgccgggagcactatggagagtggtggggtctgcaggaacctgccaccaactagattgggcagccgctctcctgccgcacgtctcctttcacatctgtggccagagtctccaacttttcaggagaaactgcagatctagattttcatatgaaaatgttaagacataattcaaagttttttgagaagcactctgcaagccaaataaaacacatcagcaggacggatctggccagcacagcacattcatgacctctgtttggtgtcccctaacacccacccctgggccccagccaccttcagggctggcaggggggcctctgcttccagggcccatgctcctccctcgccttcatcctggtcatggggctctgccttccccggagctgtcccagtgttcagatgaccctgaggcaggagcccacctgcagtacagcctccaggctggtcagccggtgtagacatctggtcattcttcatgtctgtcacctgcccagctggtcacaaagcagaggtccgagccccaggaaacccaggaccaccaggctgtggaggagaaagacttgctggtgtttcatggcccttgtttgctgttaccaaagctcatgtttaaacacaattactttctgctccactcaggcaacccagttggcacacccttccagggaccaagtcccatggcctttaaggaagccctagcatggggctgcccattccccagacatgaaaggcagctagtaagtttgctactcattagctgtgtggcctgggaaaatgacttagtttggctggcctcagtttcttcatctgtaaaatgggaacactatctcatgctagataaaaaaggacaaaattagacaaattagataaattccctcccagcttcacccatgtgcagaaatccttgaagaaggagaaggcgaaggagaaggagaaggagaaggagaggagaaaggggaattaatatttgttgaacctattatgcatgaggcaccttgacaagggcttacaaatgtcatctcaactcaccctatgaatcaccctggcaggctatcaccccacttcacacagcccctatttccacttcacagatgaaatcctgagctccaggtaagttgagctatttgtccccggaagggcccaagatttgaaccaagattcaaatttggtcggtctcaacattaaacctagaaacccggccagctgcagtaacccccctgcagtgccttcagcctctggccctggaccgacactccctcccatggctccaacatgtgtgggcccaggctccagcgccctcctcaggggctgccctgcctctgctcttgagaggacctgcaggcctccatcacccagcccacgcttcctgtctgtgttgcaggggtgcccaacccagtgctggcctcttcctctcggtgttgcaggcggcctgccaatgccattccttgactcaaatggactctgtggacaaaagaacactcccccaactactgccttcttggcccaggcaactccttctcatccttcagaacccagttcagacatacctcgtattgggggctgtgcctggcaaccccagctccccaggctgggctgaatgcctccctaggccacaccagcacccaccttggccttgatctcattcactatcagtgagtccactctgcagtgaggggcaacgctgagctgaggtaaggcagctctcctggggccactgccttaacctgagggtcccagcagctgtccctggggcccctggtccttgcctctgatgccaccctgtgctgctgttacccactctcaagcaaaccacaccctggtgggaggccctggggcggcagaggctgtgaggacagagcctgaagcctctgctggggtcccaccctgagctctgaaagaacccccaaatggaagcccccaccctctgtgttgcactttgcttttcccatgtggccacaggtcccaggttggggactgggccaccttcccttcctcttgctttagtttcatgcccagctccgggtgtcttctcgtcggggactctgcatgcctttctcagggctgagcagagctgaggggtccaggagccctggttacccccaggtgacatcccgtggtattgttagcatggaggtgatgtagtgaagacgggttgtcagctaggatgggggcgagatgaccatctaagcaatgtcagagcagggcacgtactcaaaaatgtacaaacgtatcttccaatcttccagctgttgggagagcttgggccacccaagggcacagcgccccctgctggccatgacgatgatgcggcttagctcacagggctttcctctgcagcagctccccagaagccaggcaggggagtgctgggcggggtgggagagggataggggtgtgcatgcatgggccatttctcattctctaacatacaaacgtgctctgacacctctcttgaggaccccctgtgcccactggcaccaccaacaaatcaatcacatagccaatcaacaaattaacaagcacctgcagtgtgcacacactggcccagactcaccttacctggatgctccccacctccactctctgtgttcaatttgccatagtcctcctgccccacctcccatggctctcacccccacagaactgccccttgtgccttcctcctcaaccaggtcctcacgcccccaacaggacacatacccagggcccaaccacgtggcctatctctgcactctcctgcacccatccatcccgcacaccacccacactccagtactcttgccaagaatgctcgagcattctcaccaccagctccacaacctccagggcttccctgtccttgagaaagagcccagggaaaggcttgggtgatcagacccaacctgcagacgcagccctgcctgcctgactcccactcaatctgccctctaagcaaactgcagcagcacagcaccattcccagaaagcacccttcacagcagcctcccacacatcttcacagccccccacctgcacaggcatactcagcctcacagagtccccctacagccctgacccctcgttcctatggaagactcacgccgaggccctcgtccattcccattgcacatggacccaccaggccactcacctcttcatctgagcccccacacccagaagcacccatgccccaacaccctctgtggtatccaccctcccgcccacactcagggttctgtacagaaaggagggatgcagggagtgtggtgagcataggccccgacgcccagtttccccagagaagcctttcagagaaatcgctttcacatggcagctttggtcctccgggagggcagcggctgaggagggggcatgacggggcagccagcgagaccattgttcacgccttggctgctggagccaagcccctaccccagtgccccttatccattggaggaggccgcaggaaaacaaggtctggtacccgaggggcccagtgacccgtttaagcagctcccctcaagcagaagtttcccacatgaccttccagccgggccctgggctttcctgcctccacagcaaccgcagtcccctcgcttggcactgtgtcttggcccagggcacaggggaagggaggaaatggggaggtggggagaggatgcacaggcctagcccgggctcccagctggcaacagcccttcttgtaaggacttctgggccctctgggtcctctgaccacctctttccaccacccaaaactggtcatggcctgcatgggtttggggacccagtgagctacactcacatcactggatgcttcaaagcagctgtgtgactccaggcaagtgtcaggaccgtgggttcctcatgccctcctggctatcaagcttgaagggcccacgtggagattcgagggaaaatgcacactcaggcccaggagcagtgcctcacaccagtgagtggagttcccttttaacatattcttgggtattgcctccacctagggtctgtttgtccccaaatttaagcttcctgggttctgactatgttgggcccagtggtgtggtctctgcccagctggatgtcagcctcccctcggcctcaagggcccagtgctaccacccatgtttccttaccatgactctgagcagtgctggtccctctctgagtcccaggaatggtgcacttgtctgctaccggtatctccactccccaagaaccttcctcacccatcctactgggccacccaggacttctggccctctctggacttctgacaggctctgctataagcccaggctctccacctcctcacacccagcccctcacagggccaacgcaccttagtaggtgcttggccaagggtggcagggccatgttcaatacacagatttcctctatgagactttgcggggaggacagagagcttgccagcagcctggcctcttgtcccgtgccctaggccctttggagggagcccctgccctgaccctggggcctccctacctcttgcactattgcctggccttctatagccagcccctcacacctcccaagctgtggtcacgtggaggccctgccactcacgggccatacctgccatgtcctcggagccttaagatgcaggtgttgagagctcggtgttgcctgtaaaggtccccctggaggggtccctcccatcaggcctggaggctcgggtctgtatacatgcatctgcatggggcatgactggtttccagaacctcagagcccaatccacctgcccacatagcccataccagctgaccaatgacagtgaggcgaatcaccagtctcctcctcactctgaggcctccctgcgctgaccctgtcctcaacttttgatttctccttcttacagcccagctcccacattggactcagttctgtgatttgggatctggccttgacctccaacttgccccagattgtgccttggacttggcccagtccatgctcaggtgggccacccagagccactttgggcctctcagagcttatttcctttggtgtttggtgctgtggacagagaatagtctggcggagaggggagctgagacatgcaggatgctggtgcctggaatggctggcactgagcccatcgctgcctggaaccactggctgcctcctctctgtggcttgtctttgccatagtctgtgagcttggggcccacaccccgtggagcaccatggccagacccaggcagcaaaggtgaggttggcccacagggaaacctgtggaaggctctggcccccaccccatcccaggctcaccctgcctcacagaaagcacaggagacccctggcactggggctggagcccaggacacctctcccaacttcctctggattatgaaatatatttcatgtgatatctcaattcttttcaaacaacatggagtgacatctgcagggcactttcctaatgctaaacaccttgggtcagcagtagaaatgcctccagtcattggggtggctcctaatcttcagatgtcaggcgccagggaacccaacttagggactaagatcctcacttgggaagggtcctgggggccatcagagggatggccatcactcacaggtgagcgagtgtgcacatctggattcatttccacgactcaggatcacatcaggcagcatcaggggccccaggagggatggaggtcacaggctcccaccctcgtcttagccctggaaacatgaaggcctccagtgccctcctccagtaaccccgtgagtgcctggcacaacagtgggcactcagtgaatgccggtaagtgcctgttgaccagagctcatatgggggagtgcacctctctggcaagctggatcccatcagtgtcggcccacatgtgcaccagcctcgtttcagctgggagaatcgcatcaggacaatgggaaagcttctccccgttcccctgccaggtgggcccaacgccagagccgcgatccagggcatcgctgctaagtttccaggctcccgtcaggcatcactcccacccagggggaccctgcactgtctcacttctttagagacagatcaaattggagagagttggctcacatcaaagacaaggcctatgttgtttacacacatttttttgggaagagggaacaaattattttccttcttgtccatgggatgccaatgatgagttctggagaaccactcagagacacctgtcatgaattcccagggcagggttagtggagatggagcaaacagcccacagcgcaggctcctgatttagaagggaaagtgcagcatggattctctaaagtccagcagcagcagcttgcaggagacactgcggcactcatggtgccctgaaagttgcacgggatggaggccacaggggacgatgcatgctgatgacatggcaggaagggcaggtcttgactcagcccaagggagcttctacccggggccgccgtcctgcacttctgagcatattcatcagggacaaggggagaggcaggctcatggccctagggtctgggtccccctgacacacccacacagtggtggagccttgaggacagcctggggcctgctgcaggtgtcccagggaagagggcatgggggatctgtgcctgcccacattggaatgcctcccccatgggaagcactgcaggctgggcaactctgggggaaatcaccaggagcctgcacagaggccccgcccaatgcactggagcatgaagcaaggagcgtctgcctgccctaagggcaccccatctggagagagtgactatggcactggccatcctgtcagccgggagcctcagggaacaaaggcagagagagcccccagaggagatggcagctcaggtgagcctcaagtgatcacctgcaaggaggggatttccacagaggggcgtgagtcgacggtgggatgcagcttcttttattcatttatttatttatttgtttggccaaaaagaagaaagaaaaagtcccactcatctttaccatccagatcacattgggcagaggttcaaggaacctgcgtgtggcaccctgggtggaagaacgctctggtcccgacagcagtctccctctgctgaggccttccctgactccccaacacccgctccccatttcccttcccttctctccctgctctgcagcctgatcatcacagacgtagtgtgggctccacccatttttggagaccgtcagcccttccatggcagcaccttgctttcaccgggctcccagtcttgagctctgccctgagtgcctcccatgcacagtgctcattcattttggttcattcagcaccttcccattttacaggtagagaaacataggcccagagaggctaagtgacttgtccaaagcaaccagctggcgcatggcagagcaaggactccatccaggcttcctgaatctgcatagttaacccctgggccatagaatctaaaatggtaacattatctaaggtctgggatttttgcagttgcaatgttcccagagccgaaaacagtgggtggcacataatgagatcttcataaatgtttgtgaaatgaatgtagacccagccctcctgacactgaatctgcaaccccccaacacacatgcattacagtgagagaaatttgtcatcttggatgcactgaaccacatggcatttcagctcagggtccccactgtctgtgtcggaagcctctggggcctgggaaagcagcacaccccataccctcgagtaagggtaaactaccaggaagcaatgtcgggtgcagagagcatggcctttggagcatctgctggagtcattttcctgaccctttgtccttctgcccacagttctctccccttctcagcacagcatggaggtcagaggccgccgtagaagcctcattgaagagaagacagtctgtactagaaactcaaggattagaactgaggttgaatcccactttcgcacttggaagctgtgtgatcttgagcaggtgttccaacctctctgagctccagatacctctggattgacaaggtcagggtttctccctgagaagtaattttctaacaccttgacatacacactctcctggcctgtgtcctggaccactgggccagtttcaacccctctgctggagacagcagcaaggtccctggacgatccctatgttcgaagtctgcttgccactgcctccaacagcctgtctgccattccccaggcctcagtgctattctgtggtgagcacagaagtgtccttgcccagtctcagtttttatttattttttattgtcagcctcagttcctaaaatcttaccacgttattagaggaaggtatatttttgacaactttatccacagttaccttaaatcaaggtgtcatatacacagtgccaagactgaagatgtttttcaacataaaaatccattttgttgatgcaaaggctgttgagaatcccttttgaaatttcatcagccagtactcagaagacttttggatttgactaacacagaggaatctcttcttggtaaaggacctcagatccagatgttgttccaatggaaaaaaaaaaaaaaggaagaagaagaagaaaaagaactttttccaacattcctttataaggaagctggtgctggggatatgatgtccactttactgggacaaaccaaaatatcttgataagtagaaaattttttttagcaaataacctgctgttggaaattttttaaaaaataaacacagtcctataatctatgtcaagttcagtggtaaacatgaataaaaagaacttaaagaacttaaagagtcaagcgtcatctgggtaccagtaaactcaatgtaagtggtgattcagcaagtgagcttaggtttttaaaatgtactttcaatttttttgttaacaagaaatgagttaacttattaataaaatccaaataaaatgtaaaatgtagtaaggttggcacaaaataattcccatgcatgtgaagtctgcacctgtttatctggggggactataatcttgcagaaacttgaaacatcctgacatctttagtatcttgctctgcaaattgggaattacagcacctacctctcagagttgtttgttcacttcccctgccccacattccaggtgaacccccgacagtgggtgcttgcttccccaagccagaatttaggtccaggtgtgtgggtccttacggcacatcctaagtgacagcatgcaggttctgcctctgaagacagcccttccctccttccctttctccctccctttactccacacctccgcatgagcatctagtgggcacaggccaggggcaatgctctaggacttggtgatacaacagtgagcaaaatctctgtcctcacagcgcttaccatgtagaacaagaagaaagatgctcaaggaacacacagatgtctaaagtttaatgcaaataacataaaagccaagataactgagtcccaggctgttccacccttcccccttttaaaacaatcccctctgctttgcatgcaggcttctctccttctaccctagcccaggtgagggcattcagagagctccagggggcatcaaatggaaggggtggctcaaggtctcaccagcttgcagcctcagcggagagcagtcactgcccctgtccagagtccgagcaagctaagcaggcttgggtctgatcagcatccaccaacaacgagggcatgagggagggcgagtgtgcagagggacaggccacacttcttccaatcccatgcgtggaggcaggcaggtgccctgctgtggctgtggggcaggactcaggggatggaccagctccaggaatgggtatggaacagattcacatggcccaggtcagattcatgtcacagcctggtgggcagcttgaccatgccagcaccagagcacaggccctgccatggaggctggaacctgtgggctgggctgccaggctttgggcttgcggagcaacacacctgccactcaggatggggttttgtctacggcgctgccttgtggacagtgagattggatgggggagcagcagagcagtcaggaatgatgaggacacggggtggtcctcaagcctggtccatctgctacggcaagcctagtttgggacttaaggtggctgcaccattgtagtggttattacgtgggttttcagaaccagtcttcggatcaaatcccactcctgctccttctcagctgggtgaccttcagcaaggcttcctcatctgtaacttggcaacagtgacaggtgccttgcaaagctgtcttaagaattgatgagatggtgaaatccaaacctcaagctaaagcaagtggggagaaaatggtcactgctgtgaacagacatatcagcagcagctgtggtgcatggcagagccgtcccccctgcagcatcattccacgaggcgtggctgggtaggccttgcggggccagcacattctcaccctgcccacctaccaaggcctgtttgtgttaatgtcacagctctgaagcattatcatcagaggccatgagatttcaaaggagcttcctttgcagagccacattgctctgtccataattagcacaagtttccatgagcatgacgatgaggccagaggggctgccctgcaggctggtttgttagtgtaagacattcctggggcatctgcgtagcctgggctatgcttttccagccctcgctccccctggcccctgccctcagcagcccccaggccctcattaagggattagcgatatgggccatgcaatcccttggccatctgcttgagaagtgctgggttctttgctctgtcccgcctgaaccttatcagtggtcctcgcgcaatgtttgtgttgcaaaaatcaaagcaggtcttgggcggaaattatagaccactggtgtcatgagctaattaaagactacggggtcatacacaagggagaggacacagatttctcccactgtctgtccttctgctaatgggacattgacaagcacagaccaggaagaaggctgagaaagccagcagcccgtgagagtatgataaaaggtgacagtgacaggtcttgcttcaccaagtacagattgggggatgctcctatcagggcccagcacccgtcacaaagggtgtggctgtggggcctggcggcaggctaggggcactcccccagcagccatccagagcctgagggaggggatctgtggggggacagtctcatattaatggcaacacatttatgacccaggaggaagtttaggacagttctgaatgtctacatctccatcatcaaaacagattaaaattcaagaataatcttgaacaatggaaaatagacaggcagggaaaaaccaaaatgtaaccttgaatagcttctgctgttgttctctgtttaccaggaggctgtgagcttcttgaagggtttggctcccccacatgcgaggtcggggactggggtgatctaagtgagtgatgggagctcaaacccttgcacatgggatgagataacatccctaggtaccatttgaatgctctctccccctccacactcaccccagttcccagccccaggcagatggaccagactccaccgctgaatctaaagtaaaggcggcaaatgtacgaccactagggtcaatatctggtgacttaggtcctgatgagagtgcttgccatgattcctgcacagagggtgatcctgtactagaggactggctccaaagcttccaccggccagggaaggggtcacaggagcacatcaccacccaagcaagtgtgatccctgccaggactagcagtgctgcagtagccttgcccactctcctgcggtcaggacccctcagtgatggcacacgtcatccagtttggaaagatcatccagcctcaagactgggcagcacctcccactcaatgcacccatgtggccagcccactctaggggtccgggacacgcttctgtctgggtgcgggggtattcgaggggggactgccatgtctgtcagggagtgtgggaagcagatgctgtaaggtgcaaaccagtaattttctggggacaccttctgagcccctcccccttccttcagccattctccatgcccccttttgctgagcataatcctcaatttctttattactcaatccagccttctctggcagaggagtatctactattttccaggggaggcttctcaaaccaaggcctgcaggcgaaatccagcctgctatctatttttatcaatgaagttttattggaatgcagccaggttgatctgtttatgcactgcctatggctgctttcaggctatgatggcagagttgagtggttgcatcagagaccctacggcctgaaagcctaaaatatttactctctgactctttatagagaaaatttactgtctcctattctaggaggtatagaaaaactattttagtttagcctcataatgtccctgggcaatagacgttgattttcatttgaaggaaagccaccaaggcttggcaaagttaaatagaacccagctgttagggaagggaggtgggcctcaaagccacatgtactaactctaaagactgtctttttggcatttgtcttgttgcatctttggcagaataagccgagggtgaaatgttgccttgatcctgttgctggagcagggctagagcttttacacctcccaaacctgcaggatgtctagtaacagcccccaacttttctccatggaagtcccggttaaaatccaaagacaaatgaccctctccatattatcctccaagatccaaaattactcattcaaacagctctttcctcttctccttaggtttgtgacataaaagtgtatccaccagtgagcctcttcctcctccctttgatccaggcattgtgtgtgcatttggagcctgagccaggtgggtaaggtgaccctggatgccgcacgaggtcctttttgggactggcaggtgcctcttcactgggcagtggagacgcaggatgagggagttgatttgtggctatagagaagctgtcagagacagaacctctggttactcagtgatggccctccgggagtcaggaacccaacagacctcatctttagtctgtaggatcccccagaaagcagacgcgctgggcattagagtgcctcttgttctctctattggctgtcaagcctctgaacgcccttagtgcttgaagaactggccccagcatggatgagtcctgcaggattcaggacctagctgctgctacagacacggagcagggcagtccagactcagccatctttctgctgctgcacccacctacttgttacctgaactctgccacccagcagtaagctctgccaggcctcacagtggggtggtggggtgtggcccacacctcgccaccacccacccccacctccaggttgacctcggtggtcaagcttgccttgataccttcctgttctccaagcctgtgctccaggattctctgtcaaccaccccatctgttcaataaattcattttctactaaagtcagcccacacctgtgcagaaacagggttggagcaatttaggtgccttgtccaaagtgataacagatgggaaaaggcagagctgggattcaagcgcatctcctctgaccctaacaagcacaggctgctctcgctagccacacccctctcaaggagcagcactgctctttctagaccctcagaaatgggccacctcccagatgccaggtgtgagtgtcctgacacctgcccctcactctcctccccagccagggcttctctgatgaattttcccaagtcagcctcttgaactacctgccttcctgggaaacaccttcaaatctgcagaggaccaagtgggctccagaaatgaaagtggagcatttcactgtgtgtggagcagtgagaaagggagagggtaggcttggagagtgcagttagcctgcattgggcatcctgacccgtcgggccccaagatgggagggcacaggagcctccagtcacaggaggtccttggggggacaatgcccaaggcctagttgaggaagggggcagagagccggctcccagcacacctgccaggccccacacctgggaccttggggtcccagagatttcttttcaatgcctaaagctttgctctccgagcctaaggacaagtgggcaggacagggcaggatggcatagacttgacctccttccccttgtcccaagttgcactctccagacatgggctggctgcacacatgggctggacactcagggggaaggtcagacttcccaatctgggaccctgattttgctgttcatggccaggtgtctgtcccttggctgtcagctgtgttcaccaggtgtgtgtcccctcagaaggtaagtggctcttccagtgggagtgttgggagaaggaaggagaagagcattctgcaggcatccgccctgctgcaactgcgtgtggctgagtgccccacactctgtgcccagggccacctgtctcccattatggctgaatgtgctaatagggagattccagaccttagttcccctggtagtaaaggtgaccctgcagctccatctcaggggtgtggctccctgaggcagtctttcacccatgagagacttgcccaagatcaagacagcagaacactgaagctgagctgcccctccaacccagctctcgccgaccccaggaatcagggggctccccacttatttcctcctgtgttccagggctaaacattcggctttacacacacacttacctgcatttaacacctccagtcatcagccctgcttgaatcaagttgcctatgtgccagggaagtggtggaggtgaccgctcctgaccacagtcacctggccccactgggcaggagcatctcctggccgggagcagtgagggtgggaaagtcattttctcaagcattggatgggggctggaggggagcagacatgctctgtggtgggctttgggaacacagattccttgttctgggtgagcggtcatgaggcaatccccatttcctcatctataaaatggaaaaagaacctgagaatgctggcctcatgacctcattgtgcggcacacacagggaggatcagtcctgtggtgggtgctgccccaccagggcaggtgctccggcagtgacggggctcgtccacagctgtggcaaccccgatgcccccaccttatctggtagtcattgtcatctgcatcctccctgtcattaacctccccatgccccatgccctcccttttacatcctggccaggctgtctgtgccagctcaccagcagcccatgaaaagcctggacaatgattggagagaacagtaatgaatacaaatcattctctgggcaccacagagcctatcttgggtgatgcagcctctgggtgctaaccatccttggtccttcctggaatggctgtcaggccactgaggccgcaggcttgatgaagatggatgatggcctgtgcctgggtaatgctgtactaacacagagcccagcgtttaatcagagctctgctctctgccagagccgagtaattggaggcaggtgctaagcacaattgaaataaaatgtggagttaataaggacagttgacaaggatgttacaagtcccctgtccaagttttcaacaggaattggaaggcaacttggagacctcagaaactgtgagttaatttccaacgtttctcttcaaaaacaagtacaatcaactttagggctttttttaaagcttatttattttcatatttgcaattcaaaaataagatggtcagaaaagcagcacatgtctaagatacttctgatgtactacaggggacaccagctccatggaggcctggacacccctcttcccaccttcatgctccgcactcagcaccagagtcctccaatctgcctctctggctgtcccttcctctcccagcccattcttaatggcctctgcatccctcatcttgtatcatccaggccattgctaccagcgcagtcttgctagaatgcacaactccctgcagaaagttctattccctcccaagtagagctaagccccaagtctccatggcctggcccgagctgggcccagccttatctcccactgctcctgttcccttttgctgctctagtcatggtgaaaatcctccacctgcctggagggtccctgccacctccactcttaatacactctctccctggcctgaaggatcttccgcccttcttcattgacattcccagatagtgccccaagagctgtcctgagccccgcgcctacttcctgtgcccacccatcccacggacagcactgtccatcacatcacaccctccacaggctgctgccagtgtcctgtctcccaacccgctagactctgcggtgcccaggtcagactgtgacacctgcaggactgcaccccgcatggcgcctgcaccccacgaggcatcagggatgcactggaccagcccaaggctgtccttgtatcatgtgctatcacttactagccagcacgttccctcaaagctgcatgggtgacattgacatggtctgtgcccaccctcttcatcctcaaaacagtcccagtttatgatttcatttcataaatgactgcccccccccaccaactaagaactggaaccgtaagaggcagatgaatgaaaggaaaacagatttaagcctgaaatcctccccacccagccagcaagctgtctcgagtgccctctcggctcagtcttcagtgaagtgacacctggtgaggatgggctgtggattgtccccctcaccagctaatacacctggattacacagtcacctggagaatgagcctcagggtgacccacctccatgtcaaggggaatcttgaggtccatgagacccagctcctatgtgaggggacccacctccgtgtcaaggggactcttgaggtccatgagacccagctcctatgtgaggggaccattccgcattatccccaaagttggagtgcatggagctaccatatgatccagcaaccctactgctgggtctatactcaaaagaaggaaaatcagtttatcaaagtgatatctgcacccccatgtttattgctgcagtattcacaacagccaacatgtggtcactgagcttgactgatgctcagtgtccatcaataactgaatggataaagaaatgagtgaacaatggaatattattcatccgtaaaaaagaatggaattctgtcattcatggccacatggatgagcctggaggacatcatgataagtgcaataagccaagcacagaaggacaaatatcgcatgtcctcactcatatgtggaagcttaaaaagtgggtctcatgaagatagagagtgggttggtggtcaccagggaccaggaaggttagggagagcaaaggataaagaggggttgattgatgggtacaaatatacagttagataaaagaaacaagacctcatgttcagtagatcaatagggtgacaatagttaaaaaaaaatctattgtacacttcaaagtaactagaagagaataattagaatgtttctagcataaagaaaagacaaatgtttaaggtgatgagaatcccaattaccttgatttaatctacacattatatgaatatttcaaattatcacacatacccctaaaatatgttcaactattatgtctcaataaaaaaaagttggagtccaacttcccccaagacaccccaggaaggggttttgtgatgagcaacagctcagagatcagaaagccccctctaagtcttgctgacatcctcctgtctctgtcggggagctacagagccactctggaagcaaatgctcccttccccacccctcaaatggagcagtcccttctggacatggttccaggcccatctttttcctgctcagccacagcacctcttcagaggacctcggtggggtctgcgcagcaccgaggaggcttcactccattcgggcagttctgcctctatggaagacagtggctcagagagtcagagaatgccctctggaatcttctgtggctctgactcacacccagccaaggccttccctctccccacccaagtctgaccatgtgaggagctttgcacacaatgtccctgattctcttgcatccttgtcctcaagccagagtggactcagcgaagtgcaatgatctgagggctgtgcttactcgaggcccacctgggcctgctgtctgctcctccctgctgctcccaggggagtccccccacttccccaacatccccagccccgtctcccctggctccaggctccattgcaatctgaaagctctacaggcagctcaaactcaggtcccaaatggaactcattatggatccctccaaactcactcctcctccatcccctgctccaaagaatgacatcaccaccagccggtccccacgccagaaacctgggaatcatttgaggtgtctctggccctcatctccacccctagcaatcagtcagcattgcggctgcactggcctgaggtttcctgagcccagcccactcccttgcccactgtcattccctggctcaggctctcatcttttgccaaggctgttaccgcaccagcgccctcactgtctttctgattctaagctggctccctgccagtccttccctagcacaggtctcaagatgatctttataaaggtccaacatggtgtgtcattccagctctaaatccctcaagggctccccctacatttcaagaactcaaatgtcttgacacagcaagggagaaccacgtgacctggctcaggcctgctccccgacctgggagcctttctcttctgcacattcaacactgcttttttctcactttgacccttgtatttggactcccttgtcctccatcctcatccctgggcagtggctctcaaacctaagtgtgcatcgaaatcactgtaggggcttgttcaggcacatacaacactgggatcccctcagggtttctgataggtgagtttggggtggagcctgagaatctgcatttccaatgtcaagttcatatgatggtgatgctgctaacctgatggccacactttgagagacagcaccaccactaaaaccttcaataagcgctcgaaaggacccaaaaatgctagccgaatgaatgaatgaatgaatgaatgagtgggatacactctggccagccaaagttttgcagccactcgttaggactctgttgactggatctcacgtatgtgagtaatcttgggtggaatttctgaataagttaaaaaagacaaagctacatgttgcttttatcagggttgggggacccctgtgagtttctcttcgaggtcaggtcctgctgtgcgccctaagggtcagcatctttcccagacacggaggtgggaattggagggcctgggcctgggacctctgaatgcattcccgttacatcatttggatttctttatagactggagagtttacaacatcatcaaaacacatgtttttgtgattttccaacagccttgattcctgctaccatgtcctgttcccaggccaccactgagcacagcagacagatgccagcaagcatctgagctctcaaatgcacacagcatgtcccttctcgtgggcggggagctttggaaaatggaacactgggtgtgaaagacccagaaagggccctgtgaggctgcagagaaggggtgagggtgaggccagcctgcccagccagaccgtaactgtggagactccgtgagtttccagagtcgtgattagcatgaagaagcccctggggcccagcacagccatgatgaccagcacagtccgctgcatcagccaccgagggcctgggccctgtggaactcgccggggtagtgctcatgatcctgcttctcagtgtatctggactaggaaaccccatggtggtcaggacatccaggggagctgacggtctgtggccacatcactctccccttcaggcccaccaggctgaaagggcaaattccaaccctccttcagaaagggagttctccccgagtccttgagatccactgctctcttggggctaaactgtgttaacgaaaaattcagatgttgaagtctcaacccccagtacctctgaatgtgactgtatttgaagatagagtctttaaagacatgactgagttaaaatgaaatcattaggatgggccctaatccagtatgactggtgtctgtgtaagaagaggagacaaggacacagacactcagagggaggaccatgtgaggacatggcagaaggcggcgtctgcaaggcagggagagaggcctcaggagaacccagccctgccgacaccctgatcttggacttctagccctgtgggaactatatgggaaaccgtgggaaaacgactttctgtagttaagccccctagtctgtgattctttgtttctgaagctcaagccgactaagacagactctccagagccctggccaatgcgggcctctctgctgggtgaggaactaagcttagcgtgcctcatgaaggggttcaggggtgtccctgaggcctgtgcccattgcctgctctgtcttccccctggagagggcccttcagctctgtctgccctgggcatctcaatcccaccctggcttcccatccccacagggtgaactgcttgaaatgcagatgtgctcactgagaaagaggggcttgagccaggtttccaggcaatcctcacttgactgagccccagacggcagcactttgggccccatcccccaggcacggcctattcccctggggctgcacagaggctgtggggctgttacctggagctgaccttcggtgccatacagcccttttctctctggcctgagcattagccctctccccaaggcggtcctgcctcctacccccagaggggtgtgcttccctttaatttcctgcttcttccgtgaggatctggaagccaccttgcctctgggtgggacctgaactacacacctatagctggagatgctgccatggagcggagaaggaaggaggtgagctaagagaaggggtgggtgacaattctcttgacaccaactggggacccacaattcaattcatttctaacacaactgcctggagctagcacagaccccacaagctagggactctgccctgcaagactgcacccacttcaagatgccagccacaaatctcaggggccccaggccacctgcacttctgcctggcagagtacacatttgggggctcccacagaccgcccccttgataatttgctagaacaactcacaaaactcagaaaagagctgtccctactattacagtttatgataaaggctacagatagatggccacatgaagaggtccttggggccagatctggggcagggcccatgccctccgggctccccttccagcacacccatgtgtttcagcatcagaaagctccctgagccgcccgttccaggggctttgttggggtttcattacacagacataatggatgcaatcgctggccatgtgacggaacgcaatcttcagcccctgtgcctccctggaggtcagaggtgggcagggccgaaagcatccgtcctgtaatcaagtgcttgggctctctgatgcccttccctgccttatcccactcaggtgtggagaactctggtgagggccctcctctgggatacagaccactggcttctctcagcattttcatgtggcagaaagtgggtaagaaatattctgggggtcccttttataaggcactaaacccattccagcgggctccaccttcatgacctaaatcacctcccaaaggccccaatcctaatcccattaccctagggattaagatttcggcatacgaatttggggggacataaacattccatccattttctctcccctctctcctgagtgaccccatagggttactgggtgagggtaccactctcggtctgcaggccccactcctcctcccactgccgaaggtgtctagacccaaaggaggagaccctgccccgagtcatgctgctcccatactgccaccaggctgctgggatgctgggtggggggctgcagaggcaggtgggggccccgagagtggtgttagggcaccctgcccgatcttctaagtgacaggagagtggggcaggggtggcgcccatgaagaaaggctgttttgctgtccacgtggagagtcatacaggggatcacagtgtacagccttgggaaagctctcactaaatagtccttgaatggaactgggggggcctgaagcaggtgggttaaggggagcctccatgtgtctgagacctaagagcaggactaacttggtgaccagccggctgggtaggcagagcaagggcttcaggcttctgtctgggctgtgagagaccttgtggatgcagggtaggggggcaggaaagagtgtggagtggcagcttcattgcagacgtgctgaagatgaggacacgggagcctgggcaggggtagccatcagacatgaggacacctatgtctgaaactcagaagtcagggcaagaggcacagatttggggctagccatgccatggctgctggggagggcatgctggggctgtgatggagaagtctcctgtacagccctgtccctgacctcccacccctggctctctccctctccccagggcacagcttcccaggaaagaaaagccaatcccatgaaacattggtggtgcaagcctggcagcatctgtaacgctctcactgtgctgttccttgttgggactaagacagccgcaccagcaggcttctccaaggactgggcgaggctgccctgtgaagcacatggcccacaggtccgtgcacccctctgccacgccctggctggggtgggcactggttatcccttccccattggcctcaggatccgggttgcctggcttgtggagacttgtgccatgctcttctgattagccaactgtggaggcttccagaagtgcagggcgacaagcctgtcccactgggccccatcaaaccccccaagtgcttcccttcccactccaatacctctgcatctgaagctccatctgaggctgggaggctcctggcttcttcctagggctctggcatgcctcaccttggcagaacaccctcaaaatgtgaacacaagtgtgttggggtactgacgcagtcgatggggagaacctggcaggtgtggcatcaggctggcagcttctgaccagccccatgacccctgggtggccaccattcccttctctgcaaagaaagaggccatgagtgaccccctcctctggtggggtgaagcttcgaggagatgggacccttgtctgcctggcgcccagcttccactggcaccagtgggcattcagtgcaggaatcccctctgccctccccctccccacccctcctatccaagttgacatcctcactccggtccctgtggggtactcagaaggaaggcccaaggctgggcagagggctcactggatagcccaggagcccaactccccactttctccacccaccaacaccttgtgggcgagcgccccccagagcccaagggcccagggcagcagcccgtcctggaaactgctgtgaggcctggttgtgcactcaggggcagtggccgggctcctggcttccggcagagtcccgctgggaactccaagaagggaatggtgagtgggaggccctgaccttcttcatgtgtgtggatggaggcagctggaccccatgaggagctcaggtcacaggggctgggccctgggagtgaggggtcagggaggccagagccagtatgtgctggttgcaggtccaatcctgtcaaatcctcaccttcttcacgggaggggaggcggtcactctcatgaaccctattttacagaagatgaaacaggctcgaggagggttagtaccctaggctcacacagctgggggcagagctgggattaaaccaggttggatggggccagggaccctgagtgaatgcaccacccacgctgccctgcagaaccatgtggagatgggcacagtgaccggaggtggccttgggggtcgatgacatttgcaggcaatagtgtagctctggctctctgtagtatttcctgcagggaggcagagggcagatggggtctctgcctcatgatcctgcagggaatctgccgtcagcgctggagcacctgtgggcacttgatcctatccagctgtagcagttgtcatccccaggaggggccagagtggcagacagacctccgtgcccctcttcaggaagctaagggtgactggagctcacaggcctccacccagcctggactcctctctcccaggcttctgggagtcatcccagaggaggtggggcccagagtccatcctgtccaaagaccacagacttggattcctgcaagggccaggaaggatgagtaaagagctgaggatggggcctggtggaggctctggccacccaacaagcaccagcctctaagaaaggcacagccactgactgtgcatctgtgggctaccaggctacagcctcatgtggacagggtcggatgagcccctgttcacacaggtctgggctagcaaagtcctacagccaccctgccgcaccacacaggggagggagcaaaggcccccgactgcagaagccccaccccatctggcttcagtcttctctctgtctctggtcctgaggccctcacacgttccctgctctgttcccaacacaccctcctccaccagactgcctctgagagcagggcacaggcagcaggctatgcaagtgagaggctgtggagttaggcctggctcgctccacctccctgctgtgtgaccctgggcaggtgcttaacctctctgagcttcagtgttgtcacttgacaggtggttgtgaagatccaaagcaataatgtgtgtcaagtgctttgcatgcagcagatgaagccttcctttcctccctgaaattaacaagtgcagtgctgggaagtgggagtcaggcataatattaagtccatgctcaaataggttgtgggtctgatggcagaggtttccagctggggctcatctgttagccatgaacttctgacccagaacagaggaggagacacaggttcagcagctgagcgtgtgagttggggagtcaggggatcctgcttcccagtacctgcctctggcagggtcctgattgccgcgcaggtgggcaacgccacctagtgggcatgcatagtgccatgactcagggtattgattgtcctcacacacgcgcacatacacatgcacagagctgtgaacacacacctcaggcccctacccacaccttcacccgcacacaaacgtcttctagcttcttaccccttggatcctatcttggagctgagcatcagcagccataaaaccatgcatccttcctctttccaaaagccaatttggggattgtgtgaggacagccaggtagtctgaaatggaaagggggtgaggtcacatttgctaagggcatgatagtgcatgccaggctccaagccatgagggaggtgtcaccgtagcactgaaaggttaagagcttgcccaagcccacccagagaacacaagactgcaagccccaggctgtgcagctgtacggcctggttcctacaagctccacaaactattccttcataaaaaagggtttttctggatcctttaacttccttcttgaactagattttatttgaaatggaatcaacttgactcataattctatttagggtcccgagatgattttctaagtgacagcagaacctgcattctcagcagccattgtctaacctatgctgtcctcctcctccttctcctcccagcaacggtgtgtgtgtgtgactgtgtggtttgtgtgtgcacaaatgtgtgtgtgtggttgtgtgtgtatatgtggtgtgtgtggtgatgtatggtgtgattgtgtgtggtgatgtatggtgtgatgtgtgtgtgtggtgtgtagtgtgtgtggtgtgtgtgatgtgtgtggtatagtgtgtggtatagtgtgtgtggtgtgtgtgtgtggagtgtggagtacttgtggaatgaatgtgtggtgtgtgtttgtggtatatgtgcggtgtgtgtggtgtggtgtgcatgtgtggtgtgtgtaatatgtggtgtttgtggtgtggagtgtgtgtggtgtgtggagtgtgtggagtgtgaagtgtgcatggtgtgtatggcatgatgtgtatgtgtgcatggtgtgtatggcatggtgtgtacatgtacatggtatgtgtgatgtgtggtgagatgtgtgtgttatatgtggtgtgccgtgcatgtgtgagtgtgtgtaatgtgtgatgtgtgtggtgtgatgtgtgtatgcggactgtgggtagtgtgtggtgtgcatgtgtgtggtgtgtgtgatgtatgtgtgtgttgtggtgtgcatgtgtgtggtgggtgtggtgggtgtaatgtgtggtgtgtgtggcaagtatgtggtgtgtgtgtggtgtggtgtatgtgatgtgtgtgtaatgtgtggtatgtgtggtgtgtggtatgcatgtgtgtggcgtgcatgtggtgtgtgtgtggtgggtgtggagtgtgtggtgtatgtgtgtggtgtgctgtgcatgcctggtgtgtgtaatgtgtggtgtgtgatgtgtgtggtgcatgtcatgtgttgtttggagtatgtggtgtgttggtggagtgtgtggtgtggggtgtgtggagtgtatggtgtgtatgtgtgtggtgtgctgtacatggtggtgtgtgtaatgtgtggtgtgtggtgtgtaatgtgtggtgtgtgtggtatgagtgtgtttgtggtgagtggggttcgcggcaccaacaggcgctcagagtgtggttaaacccctgctctgcaccagatgtcctgggtgtgttcctgtggaacccgtgcctggactgcaggctgctcctggtgccttgtttctaatgaacagaacaaggcagaagtcatcggccaccacttccaagattagattacaaaaaaaaaacctcgggttctgccctgggtgcctcctgcctgctcccttgcctgtttcagggaaagccggtggccaggctgtggcctggagaggaccacgcagcagagaactgagcctggcctcagccaacagtcagcaagtgatctgccagcaactgcctgagtgtgcttggaagcagagcctccgagtgaagagagcgtgtgggacgccctgaggcagaagacccagcgaagccaccccaatccctgccccataggaaccgtgcgaggataactgttgttggaagccaccaaagggagggcagtttgtcacaccgccacagagaactaactcaatggaccttttctgtccccttctgagccccacactccctgctataaagtagggattgggtcacaggtcatgcttgcttaacacggtgcttgggaccaaagagagactcaacaaaagttccctttttcctgtccacactcagaggcaggcttggatcctgctcacccagcctcatgtgatgaaaaactccaagtcaggctccgtcccacagctggggtctgacaaacagcacccccttgccagccacggcagctggagaaggaggtcgccagcagcagggctggagagcagatctgatggcatcagctcgggcttgctccgtccatgccgggctggagtgtggccatcactcccagccacagaagctcgttgatctctgacctccctggtgggaacaggcccttctccaggacaggccagggcacctgcactcagacagtctgcgggtgctccctaggccagggctgacagccccgatggaaagctgatgccctgcctttggcacagtgagtccaggaagaggcacctagccaccacccacatctatgggagacacacctagccagctcctgattccctagcctcactccaggcacctcctaacactccttccatcttcctaaggggcaagaggcagcctcccaccccaacaacgctggctgctgcccaggctagcccagtgagctccatctgcagtcccatggcgtggatcccaggaccctgactcctgggagtgggccctgggaggagtttcagagctgctgtctcccaggggaggctggccaagcccctcttctcctgctctccctcccgtcaggcacagcagccccctgctctgggaaagtacaaagacctcacctctgagacccctccaccttcgaagctctaaaaccaggattctcgcatgagccaccctaacagcaaccctgataagatgttcttcctactttctagatgacgaaagtcagactctaaggctcaagagtttttggcaaggtcacacagcaagggtggcagtcttaaacgtggccccagaatcccttgactttccttccactgaggggtggggtttatgccctgtctttgagcctaggctctgtggctgcttggccaaagaaacactgtggacatgatgctgggccagtttctgggctcaggctgtaagaaacctgggttctcttggaacccaatcatccttctccgagggtgcccaagtggcccaaggagaagaacctggcttggccccctgctggcagccatgcggtgtgccatcttgaaagcggaccctccaccccaccttgagttgcccaggtgatgccacggggaaccatccccatgaagcccgacccacactacaatgtcatgagctaaataaatgtgtttttctaaaccgctaggtttcagggtaattttaagtaactgatacagcaagaagtgatgaacacagttcagatgatctccaagtccacagtctttttgattcccaaccatggctgcctccctgattctcactgtattagtctgaagagcttattaggggaggaacagaggccttgaaaagacccccaaactgaaatccccttccccccagggacagccccctccaggaaattcctttcagggctgtcctcgctgcatttcatctctagccctgcggcaggggtagaattcttagatgacccctaatgacttttgtcttttttataattttcctcgagtgagtaaatgtgagtatgaaaatctatcactctcaagattatgttacttatttcgtgcaaagactttgcaaatgttatgaaggttactagtcagtcagttggccttaaggagatattttctgcttgggtctaacctaatcacaggagacctttaagagtagaacattttttttctggtggtgggagatgaggtagtcagagagatttgatgcttaaaggggcttgtacactagggaggttctcctctcctgagacggaggggccatggggccaggtcctgagaggagcctctaggagctggggtggtccttagatatcagccagcaagaaagtgaggacctcagtccaacaaccacaaggacatgaattctgcccacaatctgaatgagcttggaaacaatttttcccccaaattgtccagaaaagaatgcagtcctaccaacaactcaatttcacttgtgggattctgggtggacaacccagttgagcccaccgggacctctgacttacagaaccatgagataaatgagttaagttgctaactttgtaatttgttacataggaataacaaaattaatatgatcccgttctttttgtttccagactcttccttctccaaaagtgtccttcctttttttcattgcagaccttgtaaatggggtgacatgtagatctttaagccgtggctggagcgtgggtctacagccttggccaaggcccctgggccagaccttgggagtagtgtttccacccatagctgagggctgagtgtgggcccacagtggaatgcctgagcgtgcactagctgggcctccatggcctggcagagccttcctgggctggaccggctgagtttctgagtccaggggatgccgccaatgatcaggctcccagacttcctgttagggtgactaagcccagccttaattaggtggactctgatgatctgttctctctcaatttcctcatttctaggacaataatggttctctgttcataccagaatttcctcctaaagaaccagccccagactcttcacaccatttattcagtcttctccctgtgtaaccccagcctttcccatctctttccttttctgaaacccagccacactcttacagcgcacgcttacactgctgtacaggtggggctgagtgtgcctgacgccccttcacctcctctcctcaccccagttcttggccacactctagaacgcagataacacaggagttcccatgtccatctttgaaatgagaagcctgaggcccagagccctcagcacggaatggaaggctttgaatgcaaacctagagggttcctagttactttatgtctctgcagttactttccaggtttttaaggacagtgatctttgtcttctatcaccactgaagttatccccttcagaaagaagcactggcctagatatgcaacagattgttaaaaaaaaaaactgtctgataattgcaaggttgtgtatttacttatcatatcaagaagaaacgtgtggttttgactctccatttccttactaatcatcttatctgtgctacagccccaccacattatctgtgtccactccacggtggtatgttcaccacatcactggaaaataatgccactcactgacagcacacccccaccaagctccatcttctcagaggatgagggcccagactctcaacaccctcttctctctgccccctgccattgtctccagaatgggagacgacgccaacctccatgctctgactctgctgaaaccctgctcccaggccctctctggtggcctctgactccactcttctcagccacacacagaaacatactcatcttgggtttcttcatccctcaagaatcaaaccagctcccaggccaagccctctgacattgccgtcattggccacaatctgcctccccttccacctctccccaggcctggttcacctgctttttatttccataaagaacaccccattcttttatcctgcaagtccctcctgaaaccattttcagctctatcctcacacacagaccaaacccctgcagagtccccctttctatggctgccttgtcaggaaccaaccatggataaggcaccacctgccttcctctatctcctagccagtgcgacatggaggggaagctgtgcaactgtgtgccttggctccttgacaagccaggcaacctccatgagccccccaggctgatgcacagcccagctcttcatcccttgctagcatccaacagctgttcccaatctccttctttttccccagtccacaaacccacccccacgtcccaaactcgtaccagatgaattcactttataatttattgagaatttcatcctataatgacattctcaccttctctccccttctcctgagaatgtctcttatcttaccccagtgtgtctttttctgagaaatacccttcctctttttgaaacaaacatttccctctggactctaaatctctcagcttcctgattccttcctgacctccttccatttttctgtcttctaacttcttaaatttttattttttagctgtattgagatagaattgatatacagaaaattgcacacatttcatgtatacctcttcatgagtttggacatatgcacacaccatcaccacaactaaggaactaaacatattcatcacctccaaaaatttgtgtacttttttgtaagtcactttttttgtaagaacacttaacatgaactctgtcctcttaatgtattttaaaatgcacaatgctgtattgttaaccataggtactatgctgtacagcagatctccagaacttactcatcttgcataacagaaactttataccttgaaaaacaattccccatttcttccccaccgccagcccctagcagctgccattctactgtttctatgagtttgactatcttagatgccttatgtaagtgacatcatgcagtatttgtccttctgtgactggcttattttacttagtatgtcttctaggcttatcctttcttttgcaaatggcagggttttcttctttttaaaggctgaacaatattccattgtgtatatgcatggcagtttcttcatgcatccattgatggacacaggttgatttcatatcttggctattgtgaatagtgctgcaataaatgtgggagtgcagatatctctttgatataccaatttcttttcttttgggtagatacccaactgtggcatgtctgggtcatacagtactatttttagttttttgaggaactgccatgatgttttccataatgactgtagtaacttacattcccaccaacagtgtaagaatgttcccctttcttcacatctatgcaagcatgctattttttgtcttcttgataacagctattttaactgtggctagatgatattgcattattttgatttgcatttctctgatgattagtgacgtttagcatttttttcatatatctgttggccatttgtatgtcttcttttgagaaatgtctattcagatatttttctcattggattattattattattatcattattattattagccattgagtggtttgagttccttacctattctggttattaatctcttatcagatggatattttgcaaatattttctctcattctgtaggttggttgtctctttgctttgttaattgtttcctttgctgtgtataatttttttagcttgatgtgatcccatttgtccatttttgcttaggtttcctccacttttaaggtattacctaggaacaatctttgcccataccaatgtcctgaagcattttgaactgggacacttttgaaagtgaaggaggtgtcattaataattacgcaggtcaacaggcatcaagtggactgtcctgatcatcctagccccaggcttgccataaggatatttgggatttgtttgaatcgggtgtggtaagacatgcagggattaaaatgactgtcatgaaggaagaggcctccgcacaggtccctagaaacaggaggcgtggtgccccagtcagagcccaacagggaagcactgggtttagtccggggtcaaggagagtgggaatctatgggcaagagcctttattgaggtttctgtgaaaagcaacaggcaaggcaaggtaaacaggcctaagatgagctaatttgaataataggagagggtctggggcacaggggctgcccaggtgtctggcacctggccctgggtgattagggcaggtgagtagtgatcatgagtgagagccccctggagggggtcactcagggtgtaagctctggactggttggtctgtgtcagaaaagcatgcgcttgggtgacttattcactgtccttaggaattggcaacgctgggaggggcagcaaggccccaaactgtcagagcagcagaatacagaaaataaaagggatggctaatatagggactatcagagtcacccaacaggctttttcataaagtccatgctctcttcccacccccgagagttaagtccatgctcccttcccaccccctcccccaggtaagaatgactgcctgagtgagccagtgctacccatgtacacgtgcacacaccaggtgcgtgtggaaagggagagattgggagccagggctttgcctgctgcctccccctgcacccccgacttatactgacttgacacatctaatgcctcaaatctaagtttgtgtccttcgcctgctggactggatcccaccgcctgcctggtgccacagtgactcctattttctcgttcacctggaatgccttccccctccacatgtcgaagacccagctgtctcaaggccctgctacaaggctgtttcctggaaattcagcttagggctctctccctgcctgagtcccagccgcagtttacactccctcccagcgccccagcctgccttccgccatgtccacctctcctatcagtgtgcgcttcctaagcagctcctctggggcagagagaggtgtagacactcttagaatgaacaatgctgcccacctccagcgtaaggcatggtgccgatgtgccagtgccttactccctggcagcatagtaaatgggagcagaagcctctgggaaacacgctgtcttagcctagtgtttcccatagtaggttacagggcatgtgctcttcctggggtttgctgaactgcaaaacttctcacagcttagatactgaggagcctgtgatgaagagattctccttagggcattgaaaacctttttttttcttttcttttttttttttttgtaatttatgtacttgccctcttttttctgagactcatgggactggtggtcttgaaaagcataaatgtctaagaaaggtgctttcaggagactgtagggccccgcttaagcaagtggctcctcccgcagactgcaggtcatgttggctggactatcacctattttactgatgatcctaaacctctgattaaggtgacctttgcctggtgaagctaatatgtcccatctgctccttctctttggtcccccaagggacataaactaagccagcccatccccttgtccttggctccagtcaagctaatcagctttcagtcccctgaattcaccacgcttcttctcacctctgtgcctttctcacactgcctgcttcaaccgcaaatctctctctctcatatacatcacctaatatatatatgaccatatatacagacataaatataataaacacatatgtacatatgtatgaagttggacatgcatgtgtatatgctaggctagaaagatggtagatacataatagatgatatagatgatagatggtggatagatagtagatagatcaatagatagataatagagagataataggtagattatagatgatagatatagatgatagattagatagatgatagatagatagatagatagatagatagatagatagatagatagatagatgataggagagattgcttattaggctgccccttttacttaggacatatctagaaatattcactaaatgaagaaaggtaaattaaactagaaagtaagtgaatggatggatggatgggtggaaggatgcatggatggaagtagaatttgtattacacatattggagaattttaatctgataataaacagaaggtgtggcttgacaaggactccttccttgccagactttagtcagtctgctttgagccctcttcttgactaggccgtggcctgttgaactcagtttacggagacttccccaacccttgatgtctaattaagttcctcttagtgattttccacccactgacacctgactatacccctgcaccttggctataaatccttagctgtctttgctgtatgcagagttgaactcagttctatacttgtctctctcccctactgcaaaaacctttcttgccatttttaacaactgtccagtgcaatttcttcttgacaggctgtgaatgtgtacatgtatagacccattctgggtttcacttggctgctttggacaaatcttaggcattgtaggttgtcaccagcacatttgtaacatgggtgtactgcctactgggctctctgaggaaacccttccagaaagggtcagaaggcaattcttaaatgtaatgggtgctttagaagtcagcctagatttgaagtggtgtatcagcactgaagaaacactgtgttctccttcagcacgctggaagaacagcaacgtgttactcattcaagtttgtcctcttggcccttgggctcccagaataaaagatggcttctctagagtcagaagggcaagagaactgtggggaaggaagtgaacgctggctcaactgctagtgcctgcctggttcatgctaagcactctgtccgtgtggcctcacgcaatcttgccagcaacctgcttgggcagatatcatcactgtttcacacctgggtgctcatccatgtggcttctcttcacctggcctcttggcattagtctagccctagcttctttatagcatgatggtggcttccccagggtagcagaagctgctggtcttcttaagggccagaatcaggactggcttaaaaatcatcactttgtctacattttattggtcagggagtgtcaaagctttgcccccaattcaaggggcaggaaaagactccacttcttgaaagtagagcagtgttcctgaatagggaggggaggaattgatggagaccatctactgcctgccctgacccgggacggggacctggtagggattctgctcactgaggccaggaagcaggtattggacacctgtggcatcatggaccggaagtgcattatacctacctgggccaggtacaggtgctgacggactcagaaacagatgtagggattagtggaatccaggactaacctacactcgcttacagtaagcctgcatgtcacaaatccgaggtggccctgtagagggagccacggcctttttctgctagtttgggctagccctgggccacagcagccagcccatcggtccagggggagtctagaatgtgcagcgaggccctccgggtgcttgctggccaagctgcctgggctgtgtggctgtatcacagtcctgaccgcaccctcccagccttcccagaacagagcttccaaggcgaaaacacctcctggctgttctccttccccaaatggctatgttttatgatgtgctaagtttgggggggaaaaaagaaaattcctccagctgtggtgtaatcccatctgaaggcattccagggatttgatttataatctctgggcatgagccgcatgctgggctctgtgagaggggcgcctgtccggggcgctgcagggccagggccgttgaggccctccgggtggagctgcctcctttgtgggttcccagtttccagcatgctggagctgtctccaagcccaagttgtgcatggaacaggcatgcagctaatattcagaatcaggatgagctcactctgctaccaacttgcataatatttatttattcactcatttaacaaagtttctggggactagaaaataccttaggtactgataatacaaaatgaatatggcaaagattgaaatacgtttgaaccaaggttaatatcagaggtaggtattgaaagtttcaacccaacaatcagcttgtaaaacagcggtctgttttctttccctttttttttttttttttcaagaggggttgaattatttttgtgagggtgctggtaagaggaagctctacatgaattattggagaataacagttctgaaaggagatgtggctgttctaagcccagcctggtgctggtctccccagtgtctttctctcgagaaagaaacaaatgaaagttgatctcagcaaccaggacccatctgggtacccacacctttccttcccagcagccctgcagggttgaggcttgttctcacagcctggaacacaagaatagcatgtgttccagatggagcagaatgattctggcctaggaaagacattataccgaatgggtttcagattcttattggtatctgggaaaggacggacagccacttctacttaaagaaatgcccacaatcccacttcccatcatgggcagaacatgcacatgaactgcaccccacagaggaccctgtgtacagggtggtgcaaggccaacataaaatcaagtcaggccaaagaggaaaagtgtctttgcccaaccgcggtattgtgaagggagccttgcacagctgagtcactattttgattcaaagactgtctatttctttttgtcctccctttgtccctttgtttccttggttgaaattgtgctcggtgagtgaactgtccctggcctgctactagggtcagcagggcctgagtctcatgtcacctttgatcatcattggcagcttctccagctccctgagacagtcagggcagggggctttaaaatctttgagcaactgtatacatagagggctgaatcctagacacagctgacatatactatgacttatttcatttttaaccagtaagtcttgggtctatctgttattagcagaagcttctaagcaaaacaagaattccaaaattcaggaggattagcttgacagatttcccaaacaccttggacagcaacatgagttaaaatgtgacccccatcatcactatgcattcatcatgactagcttgcctctctcaaaaaatggcctgggagagaatgggccagaggtgctgttctatctgtcaaatgtgatctatgtaatcatcctagttggcactgcagaatgaaaactcaaatgtgtctcttctcattccatgaaaaaggaaagctcctgagggttctctgtgacaatacttatgctacttattcttggtcctgtggtggcactcagtttctctaaaagcgaaaggacattatggtggcctacttcacccaaatgctaggagatcacacagtgaaagtcaggtatttgcattcattcactccttagaaactatgtactgctggaaactgaggagcagagacatcccctgcccctacaggacagtgttggtgaggatggatttaaagacaacagagcagaatccgagttgccccctgccctgattcaacaccagctgtcaacatcagctggcagagaggaggaaaagtggcttccaaagacgaaaagaacaatcaaggaagccattcgaagatagtagaaaagaaagcaacagtcagctcaagaatacgcagtagatgaaaactacagcttccacacaggaagagctaaaggagagaggccctcaaaaaaaggttacaagaagagtttaaaagtgagttgaccattttaatgatattgattcttccaatcatgagcatggaatgttcttccatttgtttgcatcatctgtgatttctttcagcgtgtaattaattctccatgtagagatctttcacctccttggttagatgtattgctagatatttttgtggctgttgtcaataggattgtattcttgatttgactctcagattgaacattattggtgtatagaaatgctactgatttttgtaccttgattttgtctgttgaaactttacagaagttgtttaccatttctagaagccttctagtggggtctttaggggttttttggtttagaattatattatctcttatttctttttcttgcatgattgctctggctaggacttccaggactatgttgaagagaagttaatgggtatgggcatgaacagacacttcccaaaacaagacatacatgcaaccaaaaaacatatgagaaaatgctccacatcactaatcactagagaaatgcagccacaatgagataccatctcacaccaatcagaatggctattattaaaaagtcaaaaaataacatgctgatgaggctgtggagaaaagggcatgctcatacattattggcgggagtgtaattagttcagccactgtggaaagcagtttggatatttctcaaagaacttaatacagagctaccatttaacccagcaatcccattactgggtatatatccaaagaaaaataaattattctaccaaaaagacacatgcacttgtatgtgcatctcagcacaatttacaatagtgaagacatggaatcaacctgggttcccatcagtggtggactggataaagaaaatgtggtacatatacaccagggaatactacacagccatataaagagaacgaaatcatgtcctttgcagcaacatggatgcagctggatgccattatcttaaatgaattaatgcaggaacaaaataaaacaaatactgtatgctctcacttacaagtgggagctaaatattgggtactcatggacataaagatggaaacaataaacactgggaactcctacagtggggagagagggagggaggcaagagttcaaaaattacctattgagtactatgctgattacctgggtggtgggatcagtcatatgccaaacctcagcatcacgtaatatacccatgtaacaaacctgcacatgtatcccctgaatctaaaataaaagttgaaattttttaaaaaagagagaaatgacttagcatgtcaatgaaagactttatattaatgacaaactctagtggaatatatgtccattttcttcacttttacgtaataaaatttaaaactttcaaaaataaaagataaatgagtcgacaacggtgcttggggaaaacaattcttgtttgttaatactctccaacccagctcttttgccttccagctggctagtcattaaacagttaaatgaaacaataaagtgtgctcactccctctgtgtatgagaattatgtttccaacacaatagattcctccataacaacactgaatgttaagagaaagtaagtgaaacaatgtctacaagccctccaagtgagaaaaaaatgacacatgaattttatacagagccaaaatgtcacatacatataaagaacttcaattaattgaaagaatgccagaaatcaaggacagtagaacttgtgagcccatcttggaaaaccttttggaggatgaactgtcatcagccaagttatgcataatgaaatttctatatactagctaaagagacaaaacaaatttgtcattacattatgctctttggatatttaattcactcctccttatcctaatattcctaatttcataaccagaagctgaagtgatgtcactttatccatgtaagttcttctccaggctcttcaggtgctaatatgcttaaatctcttcaaatattttatagtgtttgtttttgtcgacaattggaatatgaccatgttcctgcctgtcctacttattatacgggtgtgtcaaaagggcaagtgtgtcacagggcaagtggcatagcaccaggagatacacacctgcacgaatgtccatgtatctgggtgtgggcaaccagagtgcacatgagaatgagaagggctacttctgtgactttcctgaaccaatagtcccaatagagccaggctagagcaaaaccacagcctccaaacccagaggtgcctcccccagcactgatttaggagcccccagcccatctccaagtgttgtgcggcactctgaagttcctcctcacccccttgaggcagctgctccgtgggtctctggactcctcaaactctgattcccctggcagaacaccctcctggctgcaggtgtggctcctgtcccagcctcaaagcaacaggttcctgtgctcccatcattacagcgaagagctgagggctcttttcttttaattgaatcccctgaggaacgccccccaacaacaggatatccccaggctatctgttcttatcatactcataatgtttggctttgtcatgccattcacccagcctcaacttaacacactttccctgaaggtctaaatccagacaaaaatatgagcaacccttctcaacacttggcctccctaacataattacaaaccccttattcatagtctttggctctgtccagagcttaggcagtctcttcatgcctggatgattctcccacacagtatgtgacctgagaagtcaggaatgatcattgtgctctaatgtcatagcaagtggcatgccacctagctctgggggtggcagtcggtgccagaggccctgtcattgtcttccctagaggccataagaactctcatggaaataagttgaccccacaggtatgccagcccagacatcctggtgaggccccagcatgccccagttctcaacggcaagcagctcgggaagtaccgaaaggacccaggcaccatttagttttgtaaggccattcagtaaagctcaggctcttggaaagccagcctctttgattcagtcctttgttgctactcgctttaatgtttacctcattttctgcttcatgcagccagaattactggtaaataagcccttcagcaaccgtagagtcttgtgctctgctggagatgtatatgcttggagaatgaaatactgtgaacatacatatttcagtttggactgtgaaatgccttctatacatctgatttgtaagagagatggttctgatcgctaacatctcagtggtgatcctgaggagaaaggcttgacagaattttaaaggtgctctatggagtataattaaccaaatccaccccccctccgtatctgaaaaagaattctggcagtgttaccagtgaggaagataggttcttttgcataaagggacgtttagttgtttccctggggttattatttccaagcctggctgtgtgatggactcagtttccccagttgcattccaatccattcttcagaccagtccaaaacagtacttaacttataggagagaaacagtgttttaccataaaatgtgcttctgttgtaagtttgctgtagctatgccctagcagattaaggtaattcccttctattccaagtttactaaaattttttatttttaaaatatagaatggatatcaaatttgattcgaattttttttctgcatctattgaggaatggctcttgggaacaatattttctgagctcttgcatgttgatttcaattttcaccctgtgcatcaaggtcagtttttctagacataacatattggctcataaaaatctttccttggacatcttattattccatcttcttttgtattaaagcattactcttaaaaatctgataatcatctaattttcttttcctcatattcttttgcgtaaatcctcccccctccccattttctttcttcaaactgcagcaattttacttaaaatttattaaaccttggtattggtcatactcatttgatggtttcaggtatgtactatgatacttcaacatataattttaaaaacaattatttcaggaaaattttctttaattattactctaaatatttcttgaattagtgaatttgttctgaacccttgctttggtttttcttctttaaactttctgttatctatctactagtcttctttacctatcattgatccttcttatgctcttaaatcctgttttctttctccattttgttttgaaattattcctcttaagctttctatttattgtaaagcatcagttatcaatttttttgtgttccttctagtttatagattttatttctaatttttgtttctaactctttcttgattttcatactgctttaaatttttctagttctgatttttgttattccatcctgttttatgcaattctcctattgtctttaagctcattttgaaatagtaggatatcgttttctgtgacttcccgagctgcttgccattgagaactgtgttttgagtgtatctttctggtgtaccttcattgtttgtaagggatgctattcagctcctcagtcttttttttttcttatggtaacttgtacgggatttgatcataatattttctagtgcttgtttccatgtgaatttggatttcctgaactaaacttgacttggacagacagctcttataagttcactgagcttgctttctgaggttttctggctctattctcctcaatcacttttataggatcttctcttttctttatcccattctctccattctctcctcaactttgattctaaggtttctcctcagtgtgactctgttctggaaaggagccctggctggtcaccttttagagcagataagagctacactgctctaaccccttcaggccctaccatgtactcctcgcacttttccactttgaaggtgaaattaaagggatacaaagaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatgctacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgttgggaaaactggctagccatatgtggaaagctgaaactggatcccttccttacaccttatacaaaaattaattcaagatggattaaagacttaaacattagacctaaaaccataaaaaccctagaagaaaacctaggcattaccattcaggacataggcatgggcaaggacttcatgtctaaaacaccaaaagcaatggcaacaaaagacaaaattgacaaataggatctaattaaactaaagagcttctgcagagcaaaagaaactaccatcagagtgaacaggcaacctacaaaatgggagaaaatttttgcaacctactcatctgacaaagggctaatatccagaatctacaatgaactcaaacaaatttacaagaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactattggtgggactgtaaactagttcaaccattgtggaagtcagtgtggcgattcctcagggatctagaactagaaataccatttgactcagccatcccattactgggtatatacccaaagtactataaatcatgctgctataaagacacatgcacatgtatgtttattgcagcactattcacaatagcaaagacttggaaccaacccaaatgtccaacaatgatagactggattaagaaaatgtggcacatatacaccatgggatagtatgcggccataaaaaatgatgagttcatgtcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacataaagtataataataatgaaattaaaaaaaaaaaaaaagaaagtgagcaatgcccatccagtttcagacgccatcctcagcttagccccaccacacctcctagtaaatatctgttggatctttaggctgtgttcaggtctatcagttggtaaataaaacgggtccttcaccagagtttgagaagcattgctgaaggaatcagcagagggagagatgagtgttagaaggcttcatagaagagatagttcttaggccaggccctggagggcaatcagggttgaagtgaatgttgaagttcctcagtgctctgcccttggcctccatctcactttgtttgtggagcttatccattcccatgccctcaaacatcactttcaaggcaagcattcctccagacctgagttttcagctcaggaatcttttttaacatgaaacttgtagagacacttgcataggtataatgaattcagcatgaaccaaacaagtgcatgactttctccccaagttttgtcaatgaatctcaaaagttttgttgcgtttttattttcgttcagttccaaatattttgtaacttctaattttttctctgactcataagttatttagaagtatgctgtttaatttccaaatattttggaattttaaaaatatcttcacattattgatttctagttaattccataatcatactttatatagttacattcttctgaaatatagtgagactaatgacccaaaatacagtctcttttggtgaatgttctatgtccgcttgaaaagaatgtgtattctgctgtagtttagtgttctgtaagtatcagttaggtcaagcaggttggtagggttattcaaatcttttacgtcttattttctgtttacttgttctatcaattacttagagacaaatgctgaaacctcaaactctaattatggatttgcatatttttccagtttgatcttatatatccatttttgtttcatgtatttgaagctctgtatttgaaatgctatccttagcatacagtaaattcacaaatataaatgagtctgtaatgctcaactctattttgttccatttatctatctatatatccatgtgccagaatcagattgttttaattactgtgactttagataatactttgactatcgttaaggcaaaccttttccctttcctccagttaatttttctttctcaaaaatatcttagctcttttcatacatttactgttcatttagaatgtaagcatcatctgggcacgttcttgttaagtttaatcttaagtatttcacatattttataaaatatacattttatatatgcctgttgctcaaagatatttttcctgttgaagatacagaacaggggttggcaaaaattttctttaaagggccaggtggtaaaaattgtaggctttataagacatatgatctctgctgatactattcactcagtcatcgccataatacaaaagcagccacagacaatatgtaaacaaatgggcataaaactttatttacaaaaaaaggcaagaagtcagatatggcctgtgggccatagtttgctggttgtagataaagagacagactaatagatatagagaaagattaatttttacatagttatcttgtatcttaacttcataataagtttgctaatactatttttgagttgagtctattatttctatgtgaacaacgtatgaacaaaagatcattttcttctagctttccaatatttacagcaattattccacttttgtaatcttactgcattggctagataactctggagcaatactcagctactgtgctaacaggaggtattgttttgttaataggggggctctgtttttcacctacaaatttgatgttgctgttggtttctaaaaaatgttatcacgttcaagtttcagatacaatgcttgtattcaatcttttaagatcccttctaattcaaattgtttaattatgaagtaattaccagtttttgattgaggctatagacaaatgagtgttccagtgagcaatccatcacccccattgaataccaatgacttgtttttacttaatagagaccttctgaatcttcttgttcaattacatgaacctcaagacaacatagaagaaaacgaattcttccgaggaattagaaaaaaattaagtaggaaataaaagtattttgctttagactttttaaaggtgttttcctttgaggtttttcaataaaaataaatcactaaaataacttttgagtgctaaaggtaaatttagctgaaaattcaataatgttctaaggagattgggggtaaaaggtccaaaggaagataaattactaactctaatatggaagaaaaaaatctaagatgtttatttctgaaaagctttggtctaacatgtaagcctcaagaacatacaactttaaaaatatgtatttaaaattgaaagttaataaatatatatatgcttatatttaaatattttaaaacttcctttaaattagcattcatatactcacaaaggtgtcaatgaaaatttcatgttcacattgcaggcagaaattgattcattattgatataaaattatttcaatcagtcaaaagttttcactttggcattcaccttccaagaatgaagtgaaaacaaatgcaattagtatttccatattcactcctttaatttccctggaaaactaaaaattagtccagctgtaaaaatatgaggcacacattaaagaagagacatgtttaacatcaagcattgtggaatttttctttacaagacgatttcaaggcccagataaataaaaatacttcaggcaatacacagtaaatattttattttaataatagcatagaattcttctgaagaaaattgttatacattatagctattattttacagtaacagagagaaaataaaattagagatacaaatattaaaggccaattatcaaaatgaaattaacacagattattattcatatgaacaatgtaaacagaatcatctatttgatttaacatcaaatatatttttggcatataattatttttacaatgagaattattaattattcaaccaattcaaatatactcattcagccaaaagaacaaaataagcctcttagaaattcaagatttatagattgatattaaacattttctcaatacatagaatattctgatctccattgagttaaactgtacaaacactcatatctattgttttatagcttataattaggtatagcttgtcaccagaactccttgtccaaaatatcactattaattgtacgaggcaaagtcctataataaaattactgtaataatggccacatcttttcaaaaacagaatatggaagtttccattttcatgactatgaatctggttttccaaaattgggttcccaaatccagtttctaaatgtttcaacagaggtgagaaagtaaaggaaataaatgatttaatggaactctggaaaaaaaactatcatagatcttagtttgaaaaatacatcaaacatgagatataccatgaatgactcagaattatataataatgcctatatcaaactttattagttagctaaagggcaaagagtaagaggcaagttaaaggtaatacttgcttttaacaaagcagactaagtaatatgttaagtgttagggtgggataggaaagaactcaggcatggcaaaaatctcctcttgggctttctatataaacatctattttagttttggactgttcaccgagaggagctctccctatccatgaaatgcttcccagaccaacaggtcttggtctagcagctgtaggaaggcagcagtatgaaaatgtaggaaatggaagccaatttgtgtccaaagttagtccaccctaactggactctttttaaactgggttattcaaatgccagcaaaaagtacaggctctagctaaagaacatgaatagacatctgtcttaaaaatgcctggaagaggtcatgattattggccttatgttctcccagaataagaacttacaaagtcctggaaatcctcagctctctccagccacctttccaaataaaatcttaatgaatatattttaaatcctttattgggctctgtaatcccttcaaccaaatagccaagctgcaatcgttttatgtaacatctgtttcactggaaaatgtgggaagttattttgatattgtctagcaagatcaataagtaaacactgatcaccccaagccaaatgatattgcccttcagggagcttttagaaagaaaataaactgataaaccaagaaagcagattgtatgcatagcaaagcccttcagcacagtgcaaacatgttctttatgaggaggtgcaaacccacttggtaatttcaagtgagaggcaacagaagtctttcttaatccaaagtcagaagtttccgaagaacttcaagcacaatatcgtaacaaaagtgatactgctcctatatacatatatataaaaaacaacagaatgttaagtaattgaataacagaatccactttcagaaaacacatttgtaattttcagccacactggaaagttcctaaaaagagcaaacatttaactataaacacttaagaactttacgtgaatacatttttaaaactatgaggaagataaatgatcaaaatatagctcttggcctagaactagttaccttaaggcttaacataactgttttttttatcattatccatattctattaatctaccctcccaatgactactaacaaatctgtgacataaatgatgtctttttatgacgtcctgataaccttgacagtttagtggcaagtaaatatctcaaactgctatccagaaatgttttaaaaataactttagatgttacttaaatagcacggcattatggacaaggcatgtgtttggacacgaggagacctcaacttcaggcttggctcctccccttctatctgagtgaccccatggagcaggctttattgctctgaatttgaagtacttggtcaggaataccagagaatcagagcaaaactaatgtctacctcaaacagtaggaattcaatgagattatgtcaataaaagagcttttaagtggtaaaatgttatgcaatgttaatctttatattcattattcttattattatgtatgtggtgaaagcttaccttcgtttgaaccatgccagaacgttgttctctcatttgggccactatatccatgatgttgaactgtaataagatgacagtaattttgtatgatccacatgggggaaaaacacaaattcacagattgccaaaaagggtgaaagagatgtcaagatttaatcagaaagatctcattttcactcacaagaaaatgtgctatttttaacttagcccaatggataaggaagactattttaataggttttcaggagaaagcaggaagcaatcattcataataagaaatgctctccaaaataagtaataaatttgcccttgtgtgtccctgtttgttatccaaaggcagaacttaaagcagcactgtaattctggaaaggcacagaagactttctctggccccaacaatagcatatctgtttcttatatgaagatccctgtcaactcacacggaaactgggagcaacagtcgacccaacactagattccagactgtgtgtggacaccagtacagctgggtgtggtcattgagttggtgcaggcctacaaaggtctgttgctggtccacaatgagtcaagaaactgggagtaagtgctcagaaactcttatggcaatttgacactggcacagcactgagaagtgtgctcaactgaacaggatatagaccagctcaggtgttgctgaacttgcctggagagtcacatgtgggacaagctgagaatgagtcgtttcagcaagacattgtggacacatgtaaatgttgtcaactgtaaccccaaagcatataaaaatagaaaacaataagcattcctttattttcatagcttatcatttttataattaaaatttttaattaaccctttgaaaaaactttttgttttttagagacagggtcttgctctgttgtctcagctgctggagtacagcggtgtcatcatatttcactgcaatctcaaactacaatcctccctcctcaacctcctgagtagcaagaactataggtgcgttccaccatgcccagctaacttttttatttttatttttgtagagatggggtctccctatgttacccaggctggtttcaaactcctggcctaaagtgatcctcagccttggcctcctaaggtctgggattataggcgtcagccaccatatctgccataaaaaacattttattttataatacagatatacaggaagttgtacagggtggccctgtgtatctttcacccagtttcccagatggtgtcatcttgtttaacaagatataatatcaaaaccaggaaactgacattgggacaatccacaaagcttaattcagatttcaccagttttacatgcaactgttagtgagtgtgtgagagtgtgtatgtgtgcatgtgtgcatgcacagagctccatgcaattatatcatatgtgaagattcatgtaactataaccacagtccagatacagagctgttccaccacaagacttcctcctgctatccctatagagtcacactcatccaccccaatctctaacccttggaaaatagtaatctgttctccttctctatgcttttgctatttcaagaagaaatagcaaaattcactatatgaataaaattgcacaatagctaaccttttgtgattgacttttttcccacccagaataacttggagatccatccaagttgttggtgtaacaatagtttgcttccttttattgctaaataatattccatgatgtggatatgtgccactttatttaaccatcaatttgttgaaggacatctgggttgttctggtttttggctactgtgaatataatctgctatgaacatttacatacaggtttctgtatgaacataaattttgattaatctgggataaatgccccaagagtgctattgctgggttatatgtcaactttagttagttttgtttttgttttctttccaagaaactgctcaattgttttccgcagtggctggtaccagtctacattcccaatgtctcatacatatgggtaatgtatgagcaatacagtttctccaaatcttcacataattctccaaatcctcaccagcatttccaaatcttcatcagcatggggtgctgtcactatttttacataagcctttctgataggtgtgtaatgctactccatcctggttttaattagcatttccccaagggctaatgaagctgagcatcttttcacgtgcttgtcatctgtatgttctctttggtgaactgtctgttcatgtcttttacccatttctgtttttcttttttttttaactattgatttttgagggttccttataaattctagatccaaggcctttgttggatatgtgccctgcatatagttactctctagcttgtttttttttttttatcctcttcattgggtctttcacaaaacataaaattttagtttgctttccctctgagatcagtgatggcaacaacgcctgctctcaccactcttattcaatatagcacttgacattttagtacagcaataagaccagaaaataagtaggatgtatacagattgtatacagatcaaaaaggaagagacaaatctatatgcacatggcatgactgtctatgtagaacacactaaagaatctaaaaaaaaaaaaacctacaaaacctctaagagctaataagtaatttcaacaagatcacagggtacaagatcaacaaatgaaaatcaattaaatttctacgtactagcaatgaatatgtggaaactgaaagtacaaacacaataccatttacaattgctccaaagaaaatgaatagggtaaatttaacaaaacatatacaagatctatacactgaaaatgacaaaatgctgatgcaagaattcaaagaagacctaaataaatacacttaccatgttcatggattggaagattcaatacagtaaagatatcagctctctccaattaaactacagatttaaagtaatttccatccaaatcccagcaagttttgtgtagatgtagccaaactaattctaaaatttattagagaaagcacagaccctaggatagctcaaacaattttgaaaaaggagaataacgtgggaggaatcattctatctgatgttaaagcttactatatcactacaataatccaaagggtggtaccggcagaaggatagacacactaatcaatagaacagaatacggaaccagaaataggcccatacaaatatgcccaataatttttgacaaaggtacaacaataattcaatagaggaataacagaattttcaataaatgatattgaaacaactagccatcaataggccaaaaaatgaatcttcacctaaatttaataatttattaactcaaaatggactatggacttaaatgtcaaatatgaacttacagaattttcataaaagaacacaaaaaaattattcaggccctcagctaagtgatgagctgttagacttgatatcaaaacatgatccataaaaggaaaaactaataaaatacaatctcatcagaattaaaaactgtaacttctttaaaagcatttttttaattataatttaagattaggcaaattatggaaatacatttgaattactaatttttaatcagtttactgactataaaacaagcatgactggactgttcagttaagaaaagacacagctttccaaatgtggctgtagtggttaaccaaataatgaagatggaagtgactgcaatgaaatgaagacaaagagttatataattttcacttggagttatgattcctcatatattgagttttatagtcattattgattgtgaagctctaaaactacacttgtgttatttccaaagatgtactggttaacaaagcaaaggaaccattaagacttatttgtaatttacataaaaaataattaattcaaagataaaataattatcttaaagagaattagattaaaaagacaagagaggacttctggttccaaaataacagtgtagaagcaagctggcttcacttctttacaaagaaaaccaaaaccaaatatacagcactgaaattatcaccaacaatatcccagaaatcaaatacgaggagaagacagttcctggatccacagagatgggaaaaaaactctaagtaggcagtaagagaattgggtttccacatctgcaatgcccattcctccaatttgcccagcaccaagagtgcaaaaaatctccacctgattcatgatttctataccagaaaaggtgacatccaggtttcccaccatctgggttacctggcaggaaacctgtccctacctcaacccacaggaagcactacatgtgcctgaagaaagaaatatcctgagaacagtcagaaacaaacaggtgaggtgggactaccatccccagccctggaaactctggtctgtaactcagctaaaggagatgccaaaccagagtggttgtttagtagcaccacattgcagaagatacattgcacaggacccctgggcatgaatctctagccacctttcccacactgccatgatatctcctttgagactttccctaattggaatgagcagctctcttattgtttactggagccaaggcaaacttggtcgtaaggtgacatctagtgccaaaaagaaggcagcaacttagcccctcaccaaaaaaaaaaaaaaaaaaaaagaaaaaaaaaattcgacaggtaaattacatagaatctataaccaaatacattcaataaaaaacaaaaataagccagacagagaacactggaataaataactaatccttcattcaaagacatcaatacaagatatatatttcttgcacatccagaagaaactgcagtcaacacaaaaccatgacctccccaaatggataaagcaaggaaccagtgactgaccctcatgagatagccatataagagctccctgatcaaaaattcaaactagtattaatagctttgaggaaactcagagatctccaaggtaacagaacaccaattcaaaaatttattagacaaacttaacaaagagattgaaataatttaaaaatcaaatagaaatcttggagctgagaaatatattagctgaactgaaaaattcattacagcctcacaatagcagaatgaatcaagcagaggaaagaatcagtgagcttgaaaaccggctacttgaaaatgcagtcataggtggaaaaagaataaaaaagaatgaagatcatcaccaaatatagacaattacctcaaaagaccaaatccaaaaattactggtgttcaagagggagttgaacaagagcaaggggtaggaagcttattcaaagaaataataacaaaactttccaaaatgcaacagatataaatattcaggtataagagcatcagggccgggcgcggtggctcacgcttgtaatcccagcactttgggaggccgaggcgggcggatcacgaggtcaggagatcgagaccatcctggctaacacggtgaaaccccgtctctactaaaaaaatacaaaaaaattagccgggcgtgatggcgggcgcctgtagtcccagctacttgggaggctgaggcaggagaatggcgtgaacctgggaggcggcggagcttgcagtgagccgagattgcgccactgcactcccgcctgggccacagagcgagactccgtctcaaaaaaaaaaaaaaaaaaaaaaaaaagagcatcagagaacaccaaacatattcaacccaaataaggctacaccaaagcataaaataataaaactctcaaagctcaaggatagaggatcctaaaaagtagcaggagaaaagaagtaattaacatataaaagagctccaattcatctgacaattgactctcaacagaaatcatataggccaggaggaagtgggataaattttcaaagtgttgaaagaaaaaaaaaacctgttatccaagaacactatattcagcaaaggtacttttaaatatgaaggagtgataaagtatttttcagataaacaaaatctgaggattcaacagcagcagacctgacttacaagaaatgctaaagcgagttcttcagaaggaaaataaaaaaatacaaaaaaccacatacacattcaaaaagaaaacttttcaaggcataaaatccactggtaacattaacaacatggacaaaaccagaatactctattattgtaatgatggtgtgcaatccatgcctaactctggtatgaagctgaaagataaactcataaaaagccgtaatagctacagcaacctattaagagaaaggtaatataaaaatacacaaatttagataataagcagttgaaatgtggtggggatggagttaaagcatagagtatttttttaaaattttttctttgtttctattctttactttgtgatctaagataagttgtcacttctttaaaatagcttattgagatccactcaaggcaaaaagaactgggaagtccccacagctgtctgctgggcagaaaaccctaggctatgggtgccacatcagccatacacccacggcaacaccgccctgcctggagatctcacacccttgacctactgcatcaacaaaccatctgtaggtctactgcacaattagctctgactcccaagcacagaggatcagcaggcctccagtgtgctgtggatctcctggtgacctaatctttggctcgagctgccccaagggaggagagagcacaggctgccagggttccccttggggttaaagagatgtgggcatggtgccagtgactggagggggctcccctaaggcctggaaatggacctggcaggggatcatcgctaccccttcccaccacccccactgctgcaaatgtgctggaatacaaaagagccatgtgactgagagtctatttgccggccattattctcaagcaccatctactggattgaagcctaaattacaacaccccaaactcttccagtatacactgcctgtgaaatccagtgccagaatctagccacaagtattaataaatatcccatacagagtgttggccctctgaaagcacccagaaataaagccaactgactatactcagcttatgctacagtcaaacccacaagggatacaaagaatataaaaacaaaaagcctcatcgaaatgatagcaaattcaacaagataaaagaacacgtgccctctcagaagagaaagatttaatgcaagaactttggcaattcaaaaagtcagtgcctccttatctccaaacaattgtactagctcgccagaaattgttcttaactaaattgagatggctgaaatgacaaacatagaactcagaatctgggtggtaaggaagcttaatgagattcaggagacagctgaaacctaatccaaggaatttggtaaaatgatccaagagttaaaaagttgacaaagccattttaagaaacaaacaaactgaccttctggaattgaaaaattcactacagaaaatttcataatacagttggaagcattaacaacggaatagaccaagatgaggaaagaatctcagagctcaaagattggtccttcaaatcaattcagtcagacaaaaataaagaaaaaagaatttcgggccaggggtggtggctcatgcctatgatcccagcactttgggaggctgaggtgggaggatctcttggggccaggagtttgagacctgcctggccaacatggtgaaaccccatctctactaaaaatacaaaaactagtgaggcttggtggcacgcgcttgtagtcccagttactcaggaggctgaggcatgaaaattgcttgaacctgagaggtggaggatgtagtgagctgagatcacgccactgcactccagcctgggcgacagaccaagactctgtctcaaaaaaaaaaaaaaaaaaattgaaaatgaacaaaacctccaagaaataagagattatgtaaagagaccaaacctatgactcactggcatttctgaaagagaagaagagtaaacaacttggaaaacatatttgaaaatatagtgcgcaaaacttttcccaatctcactagagaagtcaataggcaaatttaagaaattcagcaaagtcctgtgagataccatacaagatgaccatcctcaagacatatagttaacagattcaccaaggtcaatgcaaaagaaaaaatcttaaaggcagctagagagaaaggtcagcttacttacaaaggaaatcccatcaggctaggagtagacctctcagcagaaacttgaaacttacaagtgagaagaaactgtggacctattttcagcattattaaataaaataaactccaaacaataatttgatattcttccaaagaaagcttcataagcaaaggagaaataaaatccttttcagacaatcaaagctaaggaaattcatgagcactagaccagtcttacaagaagtccttaaggaagtgctaaatgtggaaatgaaagaacagtacctggcaccacaaaaacacaagtacatggcccacagacaccataaaggagatacacaatcaaatctacaaagcaaccagccaacaatgtgatgacagcatcaaaatctcacatattgatataaaccttgaaggcaaatggtctaaatacccaacttaaaaggcttaggatggcaaaatggattaaaaaaataaggcccaaccatattctgtcttcaagagacccatctcacatgtaagaacacccacaggctcaaagtaaagggatggagaaagatctatcatgcaaatggaaaacaaaacgaaagcaggggtcactattcttatatcagataaaacagactttaaaccaacaatgatctaaaaggacaaagtagggcattacacagtgacaaagggaaaaattcaaaaagaagagttaactatcttaaatatacacacagctaacattggagcacccggattcataaaacaagttcttctggacctatgaaaagacttagtcacacaataatattgggagccttcaacacccaactggcaggattagagagatcatcaaagcgaaaaattaattaataaagaaattctggtcttaaattcaacacttgaccaattggactcaataaatatctacagactagtccactccaaaaccataggatatacagtcttcttatctgcacatggaatatactctaagatcgactatatgctcagccataaagcaaatctgaaaaagattaaaaacactgaaatcatctcaagcatactctcagaccacagtacaataaaaacagaaattactaccaagaagatctcccaaaactacacaattacttggaaattaaacaacttgctcctaaatgacttttgggtaaacaaatgaattcagaaatcaaaaaaattctttgaaattaatgaaaacagagacaaaacaaatcaaaatctttgggatgcagctaaagcagtgctaagagtatagtttatagtgctaaatgcctacatcaaagaagttaggaagatcttaaatgaacaacctgatgtctcacctagagaaactagaaaaaaagaacgaatcaatcccaaactagcagaagaaaacaaataaccaaaatcagagcagaactgaatgaaattaagatggaaaaatgcatacgaaagatcaacaaacaattttttttttttgagatggagtctcgctctgtctcccaggctggagtgcagtgacacaatctcagctcactgcaacctctgcctcttgggttcaagcaattctcctgtctcagcttcccaagtagctgggactgcaggtgcatgccatcacacctggctaatttttgtatttttagtagagacggggtttcgccatattgatcaggctggtctcgaactcctgacctcaggtgatccacccgcctcggcttcccaaagtgctgggatcacaggcatgagccaccgcgcctggtctgttttttgaaagaataaacaaaattgatagactgctagctaaacaacaaaaaaaggaaaatctaagcccaatcagaaatgacaaagatgacattacaactaatcccacagaaatataaaagatcttcagagattattataaatatctatgcacacgaaaaatagaaaatctagaggaaatgagtaaattcctgaaaactcccaagattcaaccaggaagaaattcctgttcaagaaaacctgaacagaccaataatgaattccaaaagtgaatcagtaataaaaatcctaccaaccaaaaaaagccctggaccagacggattcacagctaaagtctaccacatgtacaaagaagaactgctaccaatcctactgaaaccattccaaaaaattcaaggaggagggactcctctctaactcattctatgaagccattatcaacttgataccaaaatctgacagagacacaatgaaaaaaaagttcaagccaatatccccgatgaacatagaggcaaaaaaaaaaaaaatcctcaacaaaatactagcaaaacaaatgtaacaacacatcaaaaagataatgcactatgaccaagtgggatttatccccagaatgcaagtataatttgacatatgcaaatcaataaatgtgatatatcaacagaatgaatgacaaaaaccatatgagaatcttaatagatgtggaagaagcatttgataaaattcaacatgctttcatgataaaaaaaaaaactctaaacaaatgaggcatagaaggaacatatctaaacacaataaagacgatatatgacaaacacacagctaagatcatactgaatggggaaaagctcaaagcctttcttctaagaactggaaaacaggtcaagaatgcccacttttaccactcttattcagtataatgttggatgtcctagccattgcaattagtcaagagaaagaaataaggggcatccaaattggaaaaaaaggaaattaaattgtccttctttgcatgtaacatgactatatattcatatattcatatatatatgtatatatatatatatcccccaaaactaatgactctaccaaaacactctaagaactaataaactaattcagtacagttgcaggatacaaagtcgacatacaaaaatcagtgatatttctagactccaataacaaactagctgaaaggaaataaagaaggtgatcttatttacaatagctattaaaaaaaaaaaacacctaggataaatttaaccaaaaaagtaaaagacttctatgaggaaaactataaaacactgatgaaagaaacgaagaggacagaaacaaatggaaataatcctatgctaatgaattggaaaatggaatactatgcagccataaaaaaagagtgacatcctgtcattcacagcaatatggacaagtctggagaacattgcattaagcaaaacaaggcaggcacagaaagataaatactgcatgttctcatttatatatgagagctaaaaaatcaaactcatggaagtcaagagtagaactgtgggtattaaagatgataaggaaaggttggctaacaaatacaaaattaagctagataggaggaatgagctctggtgttctgcatcactgtagggcaaatatggttaattataatttattgtatatatttaaagagctaggagagaagatttttgatgttcacaacacaaagaaatgacaaatgtttgaggtgatgcatatgttaactaccttgatctgatcactacacattgtatacatatatctaaatatcactctctgtaccccacaaatatgtacaattattacatgtcaactaaaaataaaaggaaaaacaacatagatggaatcattttaacagataaaacttgagaataaaaataatcataaaggaaatattgtaatcatcacatctgattcctgtgtctatctcttagctggttccaaattaaaaacaaaagtaaaggattgtgaattattgactcaaactcaattatattattatgtttattttgcaaatgagaaaactagatttgagagaggatgagcaatttacccaaagtcaccaaaatctaaagtatgtggcaaaacaggcagtcaaacagggacccctcattaactcagaagtctacattttttctcacattcttatgtgcttgtcacttatattcattaaaaacaggcacattccatcaacattctctagtaagagtctaaacaccccgtgtaagatacagggaaggaaaaggaaatggaactcacattttctgtgtatctattatgttccagacactgtcctaagccattatttacaatacatactttaatcctcacaaacacccccaggaacctgcagcaagttcggtgagaatcaggtatccaaagctcatgtgcttttgatttactaagttgcttttgaagaccaaatattagtcttccaaatgatcaggctattaaatgtagtgtgtaaacaccaacagcatcagtgtatctgcttgattcacacacttactgaacagttctttacgatggcacagaacacgacatccacacataggaacacccctgtccggcctatgccggcactgcagtgaacaaccatgggtcctgtaaggtggctcttccttgcataacgaatatattttatgaagctatctgctgaggcaggagtgccatggtctggccacttggtgaactgcaactgttttacagagtgactagttcccgtctgttagagaaagaaacagagcgagaaagacatttattgatttcttatattagagacctcacgccaacttctaatattcaaatgataataataatggctatatggtattaccttggtattatatagaactttcaaaaagtactcaaacctctttttgatgtttataagaattctggaagttgctaggaatagaggttttctccattttacaaaggagagcacagtaacaacaataaaaataccagtattaacaggcaacaaaaattaagcacttgctatgtggcagttactatgctaggggcttcacatgaattctctcctttaatcttcacatcaaccatgtgagataggcaccattttatctccattttacagatgaaaatttaaggatgagggggacgagagatgtatgctaggtcagaaggttcacacgtttagagctggaactgtaatgtaggtgtcttgaattctaatctaccatcattcttctgtaccatgaggctacaggaaaaccaagatttcaaaatgcttagagtgagagatggactgtcatgttaggaataagaccaaaaggcaaagtatcttagtttagaaatgacatatgaaatttaattaagacatataggtgtctgacaagagaggcaccgatctcttccagcgatgaagacagggtagtcaatgaccatgagagtagattgtgggtcccactattgtgctgagcccccttgaagtggagtcatgaaactcttcccagcattgtcagataaagcactttgaatttacctatatctcatccaaagggatcatgaccctttcctcagtgtggggcccttattttatcacacatgggaacctaatggaagaactcaaaatgagtttctcacttctcctatgcttctcccgaatgcacctctttttcctaagctttctgaataaagatgctagtgctcagagctctattctaatccacagtgtcgactgaaatttgtgatagttaattttatctgtcaacttggctgagccctggtatccagatactaggccaaatattattttgtgcctctgtgaaggtattttttaggtgagattaacatttaaattggtagaatttgagtaaagcaggttattctccataaagtgggttggcttcatctaatcagctgaaggccttaagagaacaaaaactgacctcccatgagcaagaaggaattctaccagcagattgcttttggactcaaactccaattcttccctgggtcttcagcctactttcccaccctgcagatttgccaaccctccacaatcacttgaaccaactccttaaaattaatctctctctctggatcagtcccataacctgtattcagggatctcaatgttatactgctagaaaaatacacataatcacatattttgttgctactacaaatgtatgggtcaaacctcagcatcactcagcaacccttttcctggtgattgtgctccaatcaacttctttggtgatgactccaaaactcaccattctctgcaagtttcctgttcaactcctattcccttcactcttgttaacacatgtatcacctacctgccaactgaatccactagagcaatctaactcattgctttctcctataaaccattccttttctgttttctaagtctattagaccaaggaatccatgaattattctagaccaatgcttctcaacagaacttcctatactgaagcaaatgtcttaaatagtggcaatatagtagccactatcaacatgccactcataagccctaaaatgtggctacttgcaggtgaggaactcaatttgttattttacataaatttaaataacttaaatttaaacttaaatatccacatgtggttactgtattgaatatattttcaacccctcctctgtcacttataaatcataagtcataagtcacatatgtctcccaattttatctgcaaaacacttgcgtctgtgctttccacccccatgccaacagccgtagttgatcatgtcacttactaaaattcttcaatgtctcccaattatcttcataataaagttcatgctacttagctgaaatttaagacatttcacattctagctggcccctgcttacttttgagaacctcatctcatcttttattactccctggcactgaacttttacatttcagaaacacataactacttatatttgtctctacacacaccttatgctattttatattttgatcatctactttctccctccatctttttcatttgcataattctcaaaacaaatgccacctcctccagtaaacctgtctcaaaaccccaagtaaagccaagtgtttaccttctgagccccaaagtgcccaagacatatctcaacattatcactgaacacggtaagttaggtatctatcagtgagtgtaaccaacctctccactattcggtaagtactgatagtgcctggcccagtgattagcatactttaaggactcaatacgtatctgctacatttggcagaggcaggtataacccagaatcagacaacttcaacagtcactctccctgccccacctctcttttccaattttttcttctccacagaatctggttgaggagaagtagaagtggtggtggcttctggtaccagggacaagtaaaaagttacttaagaagtatcatcgatcgattttccatcctactcctaacttctagttctaagacatctgcttatgtggtgaaacatatatctaatactgatgtttaaaaacttacggacttctccacaacttgaaacattcgaatgatgaaatattgaagtatctggtagttctccaggaatacacggaagtgtttcaattccaatggcttcttcagagaaatgggccagtaatggtagcatttgataattccaccttctatctctctggttatcatggcaataacatttgaattattttccaacaccatttgccaaaagtcatctatggtgctcagcagtggtccttgagtagcgatataaaaatactcttctccacaattgactattctaatataactagcattgatgtagtccttgctttttccaagaggaacgcgtgttgaatcatctattacagaaacagaaacatctggtagataaaggtgggagatacatcacacccagacttcacgaaaggatttcacacatgtaaatccatatatctctttgaccaatagagaagatggcctaggagtttcttttcaaaatggttgagtccatgagtttaaattatttcctccctgaaaactattggcatgacctaagaaatatacaattatgggatgtttatttttcaaatcagtttttaataaatgcagaatgatatcattagcatccaggtacttttggaaatttctgctagaagtggcatgggcaaggttaagtcaagggaagtatcctatagtttgcaactgaacacaacagaggagaaactctttgtgggagtaaatgagtgatattatcctgcaaatctgaaacctgcaaacccagagcagcaggagccaggggaaaaaaaaaatctgatagttgactgcagacaaattctaggattaatggaattccaccactgtccccaaactagacagccatattttatgtccattctcagccttcatctggtgataggacatgttattcaaagcaaagatattgtggcaaaaggatgctaccaaggggaattgctccaagtaatatgggactcatctaacatggactgttataacaaatacgagagggaaaaccagctatttggcctactaaccttcactgctccaggagttccttcttcacctgacacagacatctgaagctctggttccaccaccatccccacagtgagagcagaaacacacacagcaaaggaggcccttctctgccatgcagctctctcaccaataacctctccttactactcagaatcacatggaccacttatctagtaaatatgctgacaagacctgaacaggcatttatataatatctggcagaactcttctcaaattttaacatagcacacagaaactttcccttgtaaatatgaatgaacagaaaaaatcagccaggcgcggtggctcacatctataatcccagttactcaggagactgaggcaggagaatcgcttgaaccagggaggcggaggctgcagtgatctgagaccgcgccactgtacttcagcctgggtgacagaatgagtgagactccatctcaaacaaaaaaaaaaaaaaaaaaaagctagatatataaagatacccggtatttcaaaaagggagaccattctaaaaaatcacaacaaatattctcctttctataaaagatgataacaccttaaaaactcctatttgtatattaaataaaattcaagagagcattaattatttaaaacaatactttatacctatgtttactaacaaatatgttatattactaaattataaaggtgataacaatggctttgtagggagatctttcatcatatttatgtagatatatgatgatatatgtcatataataataataagcctggcaagtgttcatcacaatgttagcagtagttattacagtatctaaaccatataaattacttcatagtaaaaaaagcattttttaaattttgaaatgagattaaatatgtgaaaattaaataatctaaaataataaaagcttgatttcatataaaagtcacaatcattcaactcaaactcctaaagcaggaattgaacagaaaaacaaatttatgtttagaaaatcagcttaaaaaattttcccagaactcagaaaaaaaagattaaaaaaacctacaataatgattaaaatggtaaaagacacagcgcatacaaggggaatgtaaaaaacgaatttcagaagcaaactgtggaattcactgcagaaaagaaataattcaagtgatcataggaaagctccctaaacagaagcaggagtactaacagaatgcagtgaaacatgcataccaggttcaagcagcatgatacgctacatgtatcaccttgtcaactccaaaacaaacctttgagggaggtgctattatattcatacttttcaaataaagaatctgtacaaagtaacttgttccatattatgcagcaatcttctagactccacagactaggtaaatctagactctggtccaaaaataattccatgctctgttgtccatcaaggaagactcaagtttgcagacagaaaggcctaagtgtcagacaacattaatgaagagagccactaagacccctagaccagcagagcataaggccacaggaacaggaacaggaagcaaaaattatgctaatggatgactaggggtaatggcaactggtgccactcccatttccaccccttgattcttgaatcttggctatggtagaaacagcatcatatattggatgctgacatggggcatgtataatctcctgaagaacattaccccagccctgcaaggtactgccacctagctttcactgtaattgagtcttcaaaaggccattcatccattctgtcaagccagccgctttgagaggataaggaatatggtaacatagtggcaatgaggccattgccacaaggtatttgccacaaagtgagttctttgattacagcaatgctgtatggaataccatgatggtggataaggcattctgtaggtccacagatggtaaattggtgggagcactgtgtgcagggaaggcaaatccatacccagagttactgtctattctagtaagaaaaaagcactgctccatgcattatggaagtggtcccagtgtaatcaacctgccatcagctagctggctgatcatcccatggaatagtgcccatcaggtactcaatgttggtctctgttgctggcagattggacactcagtagcagctgtagccaggtcagccttggtgagtggaagtccatgttgctgagctcatacataacttccatccctgccattatggccactttgttcatgagacctatgggcaatgacacaatgacaggggtgactgggggtatagtctagctgatattcatagagcatgtcactctattcacctgattattaaagtctgcccctgctgagatcaacctttggtgagcattcacatgggatacaaatatctttgtgtttgtgcctatctagcaagatctattcacgtgcctcttccccagaccttattgtcaccaatttttccaaccatgttccttcaaattccctgaccatccagctaagccattaaacatagcccatgaatcagtacacatttatacgtctggccatttctccaagcaaaaaacaaaaaaacaaaaagcaccaagtgcactacccaatgttctgcccactgggagttatttctcttcaccactgtccttcagagatgtctcaaaaaaggggctgtagtgctatagctgtcctcttctggctggtacctttatatcacgcagaaccttctgtagaccaggtccaagtcttctcttcttctgtcagctgatcataggcaactcctcatgagacaacaggtgctggctgaagagagcaggtaatgtagcaggggtgggaacagtgagcatttgggcagcttcttcgtgtaacttatttgtgccttcaggatctgctcaagcccaatgttgtatctaccactttcatttgatggtggagtgctgctgtgtatgcccaactttatggcttggtggcccatagttaagcattctctacttagttctctatgaagcagtctctaccaaggcccagtagcaggccaaaagctgtttctcaaaaagagagtccagagagggtggcaggaatttgctctaaaatcctacgtgcctgcactgtgattcatctaaaggggtctgccaaaggtccaaacagcatccttatctgccaatgacacttcaagcaccactggatctgctagatcatacagcccacgtggcagagaggcttgcatggcagactgatcctgtttcagagccttctcttgttttgggccccactcaaaactagcagcttttcacatcacttagtaaatggaccagagtagcacatcaaaataaggaatgtttcctccaaaacgccctggttcactagccattgtgcctcttttttgcttgtaggaagagccagatacaatttatccttcaccttatgattatctccacatgtcccacaacactggacctctagaaatttcactgaagtagaaggccactgaatttttgttggatatatctcctaccctctgacagacaaataagactaaagcatttgctacttcttgttcactagatccaatcagcacaatgtcatcaatgtaataaacctctgtaatatcctgtggaagggaaaggtgactgagatccctgagaactaaactacaacatagggctgaagagttaatacacccctgaggtaggacagtgagggtgtgttgttggccctgccagctgaaagtaaactacttttggtgttcttgattaataggtatagagaaaaaagcatttcccagatcaatagctacatagcaggtatgaagagatgtgctgattttctaaggcaatgaaactatatctggtatagcagctgcaactagagtcaccatctgaggaagcttacaataatccactgtcattctccaaattccatctcttttttgtgtaggtcaaataggtgagttgaatgggatgtgatagatatcaacatcacttcatccttaaagtccttgatggaggcattaatatcagcaatctcttcaggaatgtagtattgcttttgcttttttactattttcctaggtagaatcagttctactggcttccactggccctttcctgccataatattcctcactccacaggtcagagaagcaatgtggggattctaccagtttctgagtatgtttattccaattattcattccagggcttggaaaataatcacaagatggttttagggacctactgagtccactgtgaaatgaacttgaactaaagctccattgactatctgacctccataagcccctgctttgatttgtagaccacagtgatgttttgggtctcctggaattggtgtcagttcagagccagtgtccagtagtttctgaaagttctgactattttctttttccaaatgtacagtcaccctggcaaaaggctatagatccctttggagaaggctgaaagattaacagtatacatttttagcagtgtgccagggtcctccctttcattcaaggtgttctctgtgtgtaaactggctcaagtctgggaagttattgactggttgtgattctctgttcctatggttcaggttagaattttgctcacttgacctagaactcttctgcttacacctatcaaggaagaatttagtagacgtcccatctagttcacttctaggaacaccatgatcaactaatcaacaccacaggtctctacaggtcagactgttctgattgctgctttgactctgctattaccataccatgctcaccttgcctttggctatcaagtgccaccacctggcccttatctctctgggatccaattatacccactgcattcaggtttcccaactcagtggcagcaatttccactgcaatatctgaactacagagaagaacaatcacagtattcttcaaggattctgggactcgcctcacaaatatatttctcacagttatgagaaaagtacatcctctggacctcctggggtgggttggcaggtcttaaatgataaacctaatctaatattccaatctccctaatcctttggatcacagtatatagtatatcgaggcagttctggcattttatcttcatttagactgggccaccttttggtccatttaatacaaccaaccaaataaactgtaagagctctttctaactccctaatccacatattaagtccagaatctcttctttgtggtcccatttcaataaattcagcctgatcaaacactaagttccttccaccattgtcccacacccttaaaatccctccccacaaatatttcccagatttctgtcagtataaattggaaaaatcatgtagctcttttgtagcgtaacatacctccccatgggtcacactttgtaccttacctttaagggcctgctgggacttgagtctagttataggtctagaagcaatgaaggatggtagctgtgagtcttgagaagaatcagcaatgtcttgcaaggcaacaaactcaggggaggtaataaaagtttcctcaggtaaagtagcatcaatctcctcagatgggggtggcatggctgcttttactggcaaggaagactcatcagggtcaaggggttcgatacacccagctttataaggctcttcacatatgtctgcactccagttttcaagatcccattccttctcagttaatgccctcattttaacagcagacaccctaaaagggtggggattcaatttgcactgtaattcagccattttcaggatgagattttgggtttggttttcaataatctcagctttgttgttataaaatataagagtttctttcagggcagaaagagaaacttttgggttattcatgcggcacttgagctgggaaatttaatccctaagatcatcctttccttctctacattaggagtaactagccaatctcattgttctcatgagaactcaaaaatgttctaaggtatcaaatacagatgcccagaaccttgcttcttgtaaatgtctgaataggattacctaatggcaatactttgcatatctctactgtcacattacactatgaattattaatactctattcactactgaaaagtcattaatgcctttacatcttatcagattagggaagtaattcataaaactcatccttaaaattctgttcctctagaattgctctcagtaccaaattctgttactctagattctctagataaatagaatcaataggctgtatatatacagtgagaaagatttattttaaagaactgactcatgattgtggggactggcaagtcaatatctgcagggcaggccagcaggttagaccccagggaaaagttgacattgtagtcttgagtgcaaaggcagtctggaggtagaattccttcttcctctggaaattttagcgtttttttcttaatgacttcaactgactgaataaggcccactctcgttatggaggctaatcagctttactcaaagtctgctaatctaaatgttaattacatcttttaaaaaataccttcacaccaacatctagactaatatttgaccaaatagctgagtatcatagcctagcctagttgacacatgaaattaaccattaaacaagctaaaaattttagtagatgatttgaaggaggaaattttttaaaaacttatattagtttcctataaaaccaagtgaaagaaaaaaataagaataaaaatgagagagagagagagatagagaaagtacttgcaaaactacagaggtaaaagaagtaacgagaaaaggttttataagatagaaccaagaggcaaccctaaaattcatagaaactaaaaaaaaaaaaaaaaaagacaagagtagactgaagagtagaaattacaactaaaggaagatcaattaaagggtttatttgtctaggtaagaatgatggaaatgaagcatacctggtaacattatttaattccaggaaaatagttaaagattttgaaataaaagagcatatttctcatgaagaaaaggagtcagatggccattacagttctcatctaaaacactggaaggaagaggacagtgaagtaacactcagggaaaaaaaatgagaaaaaaaagaactaaaacccaagattcctaaaaccaacaaggatattcgtttatcaggataaaaaaaaaaaaaaaaaaaagtagagcttgagactgcatcaactacttatacccatctccaatcaaacaattaattcatcagaacagtgatttcaaattaagggaaaagggaaagaaaatgaagtaatagcaacaaatactacaaaacatagtttcatatctataagaagaatgacgagagccaggcattccagctacttgggaggctgagacagaaggatcacttgaagccaagagtttgagaccagcctaagcaaaagcgtgagtccctgtttctaaaaaaaaaataaatgaataaaaaattagctgggtatggtggcacatgcccatccccatagtcccaactacttgggaagctgaggtgggaggattgcttgagctcaggagtttgaggtttcggtgagctatgattatgctactgcactccaagtagactctgattcttaaagaaacaaaacagctctgtgcggtggctcatgcttataatcccagcactttgggaggccgaggtgggtggatcacctgaggtcaggagttcgagaccagcctgaccaacatggagaaaacccatctctactaaaaatacaaaattagccaggtgtggtggcacatgcctgtaatcccagctactcaggaggctgaggcaggaaaatcgcttgaacccaggaggcaaagggtgcggtgagctgagactatgccactgcactccagcctgggcgacagcgagactccatctcaaaaggagaaaaaaaaaaaggtttcttgaaataggaaagaaaacaatgtacaataaatacagtggtggttaggcctgggtttgaatcccagatctctctcctatttgcagtgtgaaagtgagaaaattacttatctcttttagcctttctgtaaacaaggacactaacatactgacaccttagaggtaggttgttgtggggattaaacattactacctataacagacttaaattagtaataagcaatagtaataaacatattagtgttactactactattattattagtgggtggtagtagcagaaacaaacatagagcaacctcaagaagtacagaaagaagcttgttaaatctctgccttgaagagcttgttttcccatctatctatattataatgctgaagtgtatgaaaattttttaaaagtgtaatataccttttgcactcacaaaccacctttttaacagtttatggaggtaaaactgtcatacatgtgcacccatgagaccaccaccacaataaagataattaaacatctccatcagtgcaaaactatcctcatgcctctttataatctatccttcttgctctcatcttgccccaaggcaaccactgagacgttctgtcaatacaaattagtttaaattttctaacattttatatatgtggaagcatacagtatattagttttctaggtttgaaatttattttcacattctggaggctggaagtccagtattgttatggtttggatgtttgtcctctccaaaccttatgttgaaaactgatccccaacattggaagtggggcctaatgggaggttttgagtcatggagacaaatcactcatgaatagattgatgcccttcctcagggttgagtgagttctcactctattcactgctgcaaaaaccgattattaaaaaggaccaggcacctctctctctccctcttgtgtcctctttcaccatgtaatctctgcacatgctgattccacttcaccttctaccatgagtggaagtagcctgaagccctcactagaggcccaatcttgaaccttccagccagcagaactgggaattaaataaacctcttttatttataaattaaccagccccaagtattcctttatagcaatacaaaatggaataagacagaaaattggtactgagaattggggtgttgctataaagatacctgaaaatgtggaagcagttttggaactgggcgatgagtggaggttggaagtgtgtggaaggctcagaaaaagacaataatatgagagagtgtctggaaaaagtgcccaaaggcacttcagaaatatttggggccaccccttccctaataggccccaaggccttctggggacagacctggagcaccactgcccttggccacctcaggatgctgctccccacatcctggctgctctggctccagcagtgggtcaaatggccccaggtagggtttgggccactgctcctgaggggctaagtggtaagccttggtggcattcatgtggtgttaagtctgcaggcatccagaatgcaagggacatggaggcttggcagctttaacctaaatttcagagaatatattaaaaagcctgggaaagcaggcagatgcctattgcaggagtggagccaccaaagagagcccctaccaaggcaatctttagtggaaatgttgggttggagtttccttagagtccccaccagggcaactcttagtggacccacaaaggtgctggaaccccacaatagtagagctatccacagcattccacctcagcctgaaaaagctgcagcattattacaacccatggaagcagccagtggtctacgcccagcaaagctatgggggaagggctactcaaggccttgggagcccaccccacacaccactgtgaccaatatgtaggagatagagtcaaaggagattattttggagctttaagatttaaagtgtgccctgctgtgttttggacttgcatggggcctattatccctttcttttgaccaatttttcctttttggaatggaaacatttacccagtgcctgtaccaccattgtaccttggaggtaaataatctcttttttgattttacaggcttacaactggaaagaacttactttgagtctcagatgtgactttgaacttttaagttggtgctgaaacaagttgacttttagggactattgggaaggaataattgtattttgcaatgtggtaagaacataagttttaaagggccgggggcaaaatgctatgatttagatgtttggcccttctaaacctcatgttgaaacttgattcccaatgttggaagtggagcctaatgggaggtgtttgagtcacaagggcacatccctcattaatagattaatggcaggagtgagctctcactctattcgttctgcaagagcctggtacctccccatttctctcctgcttcctctctcaccatgtgatctctgcatatgctggttttacttcactttccaccatgagtggaagcagcccatagccctcaccagatgcccactcttgaaccttccggtctgcagaactatgagctaactaaatccctttccttcataaattattcctctatagcaacacaaagaaactaagacaaagatcaaggtggcagcaggcttggtttttcctgaggcctctctccttggcctgccaatggctgccttcttgctgtgtcttcacatggacctttctctgtgcctttgaatccctgatgtctcttgtgtgtcccaatttcttctttatataaggacatctgatggattggattgggcacactctaagaacctcattttatattaattactactttaaaggccctatctccaaatcaggtcacattctgaggtacaaagggttggaacttcaacatacaaattttgggagaatttaatttggctcataacacacagtatatactcttttgactggcttatttcactgagtaaaattattttaagattcattcatgttgttcaatgcattgttagtcattttttattgcctagttgcattctattatgtagacataccacaatttgtttattcactcttccgttgatgggcatttgcactgtttccagtttttggctattataagtaaatctgatatgaacattagtatataagtctttatgcagacatatgctttaatttctcttaggtaaaacatatgaatagaactgctaaatcatatggtaggtacatgtttaactttattagaaacaaattccatttcattgcagtgagtgtaaaatggtatctcattatggttttaatttgcattttcctaatgatttacaatggtgaatatcatttcatgcatttatttgccatccttatatcttccctgagaagtgtctgctcaaattttttgctcatttagtgttgggttatttgtcctcttcttgatttgtagtaattatagattataaatataagtttttgtgagataaatgttttgcctgtatttttcttctagcctgttgctttcctttttggttttataataatatgctttgaagagcagggttttttttttaatttgatgaagtccaatttattttttttcttttacaatttgagggttttgtgtcctatttaggaaaaatttgccaaagccaagggcagtaacgttttctcctagggtttctttcagaagttttatgtttttaactctaatgataggtctataatctattttgagttaatttttatataagttgtgaggtaagaatcaaagttcatttttggtacatgaatatgcaactgtccagatgatttgttgaaagattatcccttccttattgtcttgcattaaatttagatattatcatcttctctgttcttctcacatgatcatacagaacactcaatgagaaatatataagcatgctctgaaaagtgagaagctaacagaaacctaagtcactaccttgattagttctgaataggtccctgatagataagtaacagaaaaaatattaggccaggagttggggaacctctgtgactcgctcttttattagccttcaaactgctttgtaagttgtgaaatggtaaagaaatggaagatattgtctttatacctaaaaattcctatactacataataaaggccattcttgcttggcatgatggtacagggccataaatatgaccatgcaagttgaaaccatgcgaaaggacctttgttgttgttgttgttgttgagacggagtcttgctctgtcgcccggggctggagtgcagtggcgctatctcagctcggctcactgcaagctccgcctcctgagttcacgccattctcctgcctcagcctcctgagtagctgggactacaggggcctccaccacgcccagctaatttttttgtatttttagtagagacagggtttcaccgtgttagccaggatggtcttgatctcctgacctcctgatctgcccgcctcagcctcccaaagtgctgggattacaggcatgagccaccgcgcccagtcacaaaaggatcttagtaattaataggaaatattattcttgtttcatggctcttaacattttttgtgaaatcattaaaaactcacttattgctggctatacatatatagagaagcaaaaaatagcaagactaatatttatttagaacattgtaatttaaaacattagaaatattgggaattaaagcatttaatttgttaaaaaaaaaaacaaaaaaacaaaacttacccagagtagtttgaacagtgtttgcctcttctttttgttgtataacttacaatacagagtgagcattttttctatgtctaggctaacttccaagtctggatcagtttccaccttttatccttggcacttatattgttgtgaaatagctccaaagtttctttaatgtcaagttttctaccatcattgcttcccctaggttgcctttatccttttcctcacaagcactttggtcattcatgtcggtaagttccccttccacaggtgccttaggctgcagctctagggtcttttgagcagtagcagtgtcagcatgtccctggtcagctagttcttctataactccattcaaatttcatttccaacattatcactttttatccctttattgcagtttcatctctctcagccaaatctctctcttgattatacattttggtaaaaggtcataggggtttaccattgagagacaaggagacaatacaatcacatgctttgctgtgtgtgaactgaataagaggctcacagttacctatcactgacatattttgaaagaagtaacatttattagtcactggtcatgatgcacatctgttatttacatagggacttgtggactaaagtgccagcaaagatgcttactactttaggcaattacttgcagtgaatatattgtggtaactaaaatgtgaattgtactgtgggactggtgttatttagctaaacacagtaactgatatttgagcatattggggccatgcaaagtgaaggttccctatatttgcagtgttcaaaggtgtgtgaattcatctatttagtgttctcagcatttgaagacgacaaataaattacttctttagctttcttaatatgagtcttcaggaaccttttctataaagtcaagaaatgtgtgattaaaaaaaccacagagctttctatgatggccacttaagttggctgagtttcagattagattacactgcgttatgaggtagatataccaatgggcctttaaaaagaatatggttgaattatagtttcttttcttttatgaaaagccaaaagttttacataacttcccttactttaatgatttaacattatttttattatctttgaatttcttagttgtaactcttttgatatccagaataaaaacttcaagtcagatcaaatattatgtgtaccttctattgtaaaatgagcttcttacaatcccgagaggctaatttttaaggcatgtttgcttttagtctccttgagggcaaactgcacatgcagaaatagaaattataaaatttggacctttgacattttggagaagcaacaaattattagtattatttattaaaatgtctaatcatggttcattattctgatttcagaagtattcatcaatgcacttctccacactctccccacagaagataacagaatagcttattttaaccatgttggatatgtacttgttttttatcatcataaagttagtttcaattctaataaaccaactaaacatgaaggtatttatctagtgaccgcagtcactgtgttccactctggtttttataataactatctcaagtctagtaggagaaacaaaagtgaaaataattaaaatatggtttggtagaaggggagagtggttacaagatgctgtgagactactggaaaaacaccaaacctagctttgaggaaaataagaaaagcctattggagctggttaagaaagatagcaggaactgcctcagcaaagaagggatgagtagttctttcaagaactgcaggttaagaggcataaaaaccaacaaataagaaaagaattatgaattctagataccaaaagaagttttgtgggagagctaaggctagagaggcaaacaggtgaaattcttaggccatgttaaacaactgtaccatgatagtaacaaagagccaagaaagagctttaaaagaagagctacatgttctgacttgcattttaagaaaatctcagtagcttttgtgaatgatcagaaagggaggcagtaaagaagaacgtaaccagctgagaggtaaaatgggctcagtctaagtcagcagcagtgggaactgagagatgggggaggaccccagaggtattatggaggtagaatcaactgactccctgttttctggtttgaacttggtgattacataagatatagaatataagaagagggtcaagttggaggaagtaaaatagtaaatttagttttgaaaaactttgactttgaaaggaatgtgagttatggaatgagatatcctgcctaagattaaaattgcattgctgtgttttgattctgctctttgaatggcctgagatggataactcctaagagtaactgagtgaggaggacagaaggtgccactaccctcccatccaacacagggaagcaacgttaaggctctgtggagacaatcaaaaggcagcctcctgttggagagcagattagcagctttattgtccaggatgaaggatgcaaatagctcttttttcgcgtgtctaaacaaaatagccagagaaggtggttaaggcttcgggtaccaaaagtggtgtatgactcagactattggattttatgttttggaaggctcatgctctgagaagcagcaatatatgagaacaaggctgaaggactgctgtaaaggaccctgtaacagtggctgaaggatgtaccagaaaacagaggacctgactctctcatatctagcacatatcttagaatatgcccagatcacccagtgctatgtaccagaaccctttatcatggtcacaggccaaaatgtctcatacaaaaagccatacagtgccctttgcactttttctaaatataaacaggaaaataatcaaaactatttttagcttacatggaagaatatctcggtatctgtttttttctctgttgcttggttgattcccagagttgaactcaccaggcagattcttaagttctaaagcctttaaaaggttaaaaatgaataaataaataaataataaattgtgtatttactataaccaataaaaaagaaaaaaatatgcctttgtttagtgctcatgatccttaaatccctatatgacatgacctgctatttaatgtgttgtatgataagtgaagctagatcctcatttaaaaagtgctatataaaatatctcaagtttcacatgccaatcaatgagttggttaataagaaaatgttaaactttctggagatactttccacttgaacttcattttcttcttctttcataaaaaaggaaatacaagctattcatttctcagaacctacccacagatctatcattttataaataaaaataacaacataacaacaacaaaaacatataaacaaaaaatatatacaaacagtctcacaatttacccttcccctttgaagaaattatagttaggaccctaagaatccttcctttcaaaaaatttctttaccaagtgtgaattcaacaaacacttattacacatttagtaggtacctggccctgtttcagacactggaatacagggatgaattggataatggcctcatccttaaggagtgaagagagtagttagaggacatgtaatcaaataccatgtgaccaatgtacggagacagtagtataaatgacagcactagattgcacctaaaagtcaagaagaaaagctcctcaaagggaaatagcccttgaactgggccttagtgagtcactggaagttagcatatgaaaaacagtgtgtatttagaaggaaagaggagagaaggtgaaggggtggaaataatggaggcatacatgtccctttgggaaactgtgactaatatggtaataagagcacaaagcacatgatctagtccaacaacagactaaaactataaaatatcttgtttcatatataaatgaaattaggaggtagctagtcatactttattagaatatttgtggagaaagcctgaaaatctatacattttcaaagctcttgggtaactcttgtgtagccaacctagcaaccgctgccatggggaacaaggagcctgtgaaggttttaagtagtacaataaaatgatcaagtctttctgaaaatcaattttaaaattaatctggaaaaaattctgtaggaagaatgagaaaaaattcatttatgaatgaataatgatggcagatgagtctcattagatgttaaaagataatatgaagctatgctaattaacagaacaataccaataaaggaataagaaaatcagtagaaaaagtccaagaataaattaaaatatatgtaaggctctagtatatgataaaagtggcattttacctcactcaagagaaattccaggagagtcttgggacaactggatagttatataatgctgagtccctatcaaacatcttataccaaattaaattctagctgcatcaaagatttaaatgcttaaaaatcataaaggtactagaaaaaaacatgaagtaattattacaatcctagagtaaaagaagcattcctaaagagcacagaaagccccaaacccagaagccccaaaagcaaagattgccatatttgaccactaaaaatcagctatttcttcacggtaaataggcatgtgtgtgcacatgcatgtgcacctgtgtgtaacacaaacaacagcagaaaaaatactacgtgtaagacacacaaaggcataattttttccttaaagagttagtaatcggccaggcgcggtggctcacgcctgtaatcccagcactttgggaggccaaggtgggctgatcaccttaggtcaggagtttgagagcagccctggccaacatggtgaaaccctgtctctactaaaaatacaaaaattagccaggtatggtggcaggcacctgtaatcccagctactcgggaggctgaggcaggagaatcgcttgaacctgggaggcggaggttgcagtgagccaagatcgcaccactgcactccagcctgggggacaagagcaagactcatctaaaaaaaaaaaaagagtaaccaataagaaaaaaaaaaaaaaggaaaatggggcaaagaattgaaactagcagttcactgaaaatataaaaggcttaaaaacatatggaaagatattcttttgttctcaaataaataccaattaagtaatcaataagaaataatttgtcatttaagagatgagaaaagatccaaaaaattgatagcccaaaatattaatattgtctttctaggaatttgttcaaaaaatatttaaatatatgcatacagtatatgaagagagatgaccgctgttcataatagcaaagactagaacaacctaaatgtccaaatgttccatggtagttaattatatggataagtaccctaatttcagaaattaaatattaaataaattaaggtacttatccatataattaccatgcaacacttaaaaaaatgagatactgctatacatgctgataatatacttggaaattgtatctaggaggaaaacaaatttaaggatgtaaagtgcattccgacaaatttttttaaaagtttgcatgacaaaatgacaaaatgaatagtgtaaaggggccctagaaagtcttgagagaaagagagagactttctattttatatccttttatgctatttggctttttttttaaccacgtacatctattactttaaaatatatataatatttaaaagtaaaaacaatgtactagaaccaaataaagaaagaaaagaaaagaaaccctctggcaatgatataaaaaaagaaatcacatatagactttcgttaagaaaatatttaccataaattcctgcatgatatcatacgctgctgttttttcctcaaggattttcaaacaatccttgatggctgtctgctcatgaaaattgaatattaatggccgaatctgagccaactgatctagttctccttcagaaacaattttgcgcgtatctaaggaagagaaaaattcacatatgtaagttactggtatatatgtgaagggagattttatttttgtttctgtttctcttaaagacacagccatttaagggtaaacagaagtttatttttccacgggtgaagagtctactactttgaaagaggcttcctttggaaaaatcatggctatttacaccttgaaattatacaaaatccactgcccttggagaaaactgttcagtgccataaacataacgaatgctgtggattgagaagtgttcagttttataatgtgaattgggtatatggattgaaaattatgccaaggcaagaacgtccaaggcttggattaggaaagagaacttttgccctccctgggaccaagtgtttggaagttcctagagtctgagatgtggtgacgtggagagttcacgtcctgtttcattactctgaaacagattgaacatgaacgcacacacgtgcacacacaccaaggatggagaggatctatgcaatataattaataagatggaataatggatacgtatggacacttgcaaccaataattggggagaacattctattaatatttaatagcacacatacaatctttttatttttaattatgatcttttaggtaatgttgacagtcaaggttccaaacatctgaaattttatacattatgtccactggccaaaatgcaataaatctagaagtcaacagtaaaagagtattttaaaagcttcaaaattttgaggtaagatgttcaagtaaaacaagttctcataatctctttgcaaagccaaataatgtgaacaataatcaagttaataccagcaaaaagatatatacaaaacaatatagcaaaagaaagaggtggaaatttctaagaatctgcacattcctgggaagcacatcttatcttggtactccactatatccagaggctctttgtagggttggaagtgagggctcttggttgggatagacaggcacagaaatcctaaaatttctcacaaatatccctaaccttagtatgagaggaggtctaagcaggctggaaggggagataaaattcccacaagcgtagaagccattttgatcatctttgatgcccaacagaaaaacccttagatcttcccattgtgttccacctttgctagtacaaaagctgggagaatgaagagagaaaaaaatgaaaatgtagaatgactgtaacaaacactggtgttgactccccaacactgattctacccctctggttagttaaagccatttgtgatcattccatagtaagatccttccagtgaataattcagaaataggtaggagatttgcgccaaccatagaaataggctggtcttgtaaaaaagagaagcaaacctctcttctaccctcatccctctgtacagacataaacaaagaagtataaggacctaattatcatagtctgccctcttatggccataaaaggaaagcgtatagcaaatgtgaaaaacataaagaaactatgttcttgatgacattagcaactgatcatattgaacctggaatccttcctatctctgggcttccattatggtagaaaatatatatatctttatcattaacatcattctgaatttggtctctttttcttgtagcctggtccaagaattccaatcaaagtataaaggtgaggtttcagctgtagatcctgggaatcatttcagccagtttacagaaagggatttgatctagctatttggtgttgtatcaccattgtgtgggcttgaagaacagatgcctctctcattatgatccaagaacaacactgcataatggtctgccaagaaaagttctgtctttgccacaattaggaaactgaggaagttggagaccattttttctagccactggctcctagatgacaccacttcagcaacaatggagaaataagaaagtcactaccacaactgttggctctagtaacacatcaccttacctataatgaggaccaggaacgccaagcctgctatgatgcatagcaataaaatggatgcctctctacacatttacatcttggctaagtgcatatgatcggcaaagcccaaataagctaccaggaagtcttgaaaatgtaatttttcatttttctgcctgggccatacaggaaggtacactaggagaagggtgtgactgatattgagtaagggcatctgtgatatctgcttaacatttcagccacaccatgccctttgagtatcctgctccttggcccctatcccttcagcacacttatcattgtcctcgggcaaaataaacaatgcagccctccaaaatacagtttacaagggaagatgatgagatccaaataaaaatggaaatcaggaagaattcattcctgctcaatcaacaaaaccgaagagacagaaaaagctatacatgttcataacaaaatggaataaaatgtgaaacacagaaaaaataataatataatatagcatgcagaataatttttaaaatctattctaaaatggaagataagcttaaaaaggaaaatgaactgtgtatgcaacatctgtcgaaagaaaaagaaaaattattttaaataagagttcacaaggagataagaaaacaatagaatgaggtttaaaaaaattagtttataaacctaagaaaataaaggtaaaactcaaaagtacataattacagcaataatttataattaaatcgaattctgcaagaaacaaagcaggcagttgaaaatcaacttattgccataggacaaaggcatgtatacatacagtaatgaagacaagaaaggtttaaaaacacagtgaaaagataatgcatgtgaggacctcatcagaggctcaggagaaaagctgcagacagggtgaggaacttgagaaatcctccttcgtggggcaagcttgggaaggggaaaaacagcatccacaggaatggcacaaagcatgcccaaaatgcttttccctatttccctaatggaccaaaagcataagaacctgagaaaacgcatgaaactctgtcatcctcaaggcacaaatgaagactcattaacattgggggtagggaagagagaagagcatcctggacccaggccataagatattccctacacctgcagaatggacaaaataataaaggaggtaccgcctgaggccttcctaagactgagactgaacaaggacagcagagaatgtcaccccaaccaggttggcaagcaaggtaatcataagtaagagctctctactgctgggaattagagaagatcatggagaagaccttctctgaggtgcatgtacaatgggaagagctaaagcagagggtggagtaaacactgaggcaaatcctctacatgtaaggtaacactggaggaatttgaagctggtggtgcactaagggtaaccatagcaacatcaaacccaagccctgctgcattactgagtaaattgatgcaactcctcacactgaaggcctaccaacaaaagagtcatgtccatccctatttacctcagcgtctagaacttagctaagaaatactacaatagctcccccttatctgcaggggatatgttccaagacccccagtggatgcatgaaactctggatagtattgaacctgatcgtcatcaactgaaacatatttttgttcatgtcttccacccataaatttaatgccttttccatcttaagtaagcatgtatcatgcactgtggccataactttggcactctgatgtgcaacagcaaaacttggatagaagattcattcttaccataggtctacgcaactttagcatatgatttttttctttccttattaagtcaagaactttcaccttttcatgtaaagaaagcactttacagcttccctttggcatatccaaattgccagcatcactactctttggggccattactaagtaaaataagggttacttgaacacaagcactgtgaggccaaaacagtagatctgataaccaagatgactactagttgactaagagacaggtagcacatagggcatgaatatgctggacaaaggaatgattcactcccaggcaggacagagcaggacagtgtgaggtttcatcacactactcagaacagtgtgcaatttaaaacttattgtttatatctggaattgtccacttaacatttttagtctgtggttgactgcaggtaactgaaactatgaagagtgaaaccatggataagacatttttacttctatctctagactatacaatattcagttttcaaccaaaaaattatagagtacacacagaagtaagaaaaagagaaaaaagttgccaagagacaaagcaatcaacagaaccagacagagatataacatatgttaaaactgtcaagtgatgaatttaaaatagtgataatcaatgtgtgaaaaggcagtgggaaaagtagacaatatacatgaacaaatggagaatttcaatggagagatggaagccataaaaataataaagtggaaatgcttaaagtaaaaaaaatattgtaagaaattaagcatgttattgataagctcatcagtagatttcacagaggcaagaaaagaattcatgaattacaaaatagatcaagaggaattatccgaattagaacacagagaaaaaaggtagatgaggggcagaggcagagaagaagagaccatccaagaactacaaaccaatatcaaacagactaatatattatacctgtaaatggaatcccaaaatagaagagaaggagaattgggcagaagaaatatttgaaaagataataactgagaattttttccaaaatgaatgaaagacaccaagcctcagatccaaaagctcatcaaaaacaatataagccagaagacaattgagtgacaactttaatgtaatcaaagaaaaaatcaaaataaagaaattaagatttcagtaaatacatgactaattataaaagctagtattcttgtaacaataatgtgtaacttcactttttcttttctacatgatttaagagatgactttttcctaaatttattagcctaaaaataaaaaaattatcataactttagattgtaaatcaacattttgttttctacatgagaaactaaagcattaaaaacattattttatgttttggaacacataatatataaaaatgtaattttgtgacaacaaatgaaagagatggggtcaaaactgtcaaaggtccacagtttttttttttttgtattttactgaattaggctggcataaattcaaattagagtgataagtttaggatgttaaatataatgcccatggtaaccacaaagaaaatagctaaaaacaatacataaaggaaattttttaagaatttaaatatttcattacaaaaggcaactaaatacaaaaggagacagtaaggcaaaaaaaaatgaggaacaaaaaagctacaagaaatatttttttaaaatagcaaaatgacagaagtctctccttatcagcaattactttagatataaatgaattaaactcaccaattgaaagaaagattggcagaatggattaaaaaataaaaacatgatccaactatacactgtctacaaaggactcactttagatccaaagacacgaataggttaaaagtaaaagaaatattccatgcaaacaggaaccaaaacagagcatgaatagctatattaatatcagataaaatcgattttaattttaaaaagttaaaaatgacaaagaaggacattatatatcataaaaggttcaatacagcaagaacatataacagttataaacatttacacgcctagtaacaatcaaaatacacaaagcaaaaattggcagaaatgaagagagaaacagttttacaataataattgaagatttcaatatcccattttcattagtggatagaacaattagacagaagtaagaaaagggaggacttgaacaatataataaacaaagtatatctaacagatacatacagaatcctctgtgcaacaacagaccacatatttaagaacacatggaatattttgcatgtgttaggctataaactaagtatcagtcaattttaaaacactggtatcacaaagagtatcttctcaaaatacaagagataaagttagaaatcaaatataagaaaaactgataaacttacagatttgtgaaaattgaacgacataattttaaaacaccaatggatcaaagaaggaattacaagggaaattagaaacatttagaaatgagtgaaaacataacacaacatatcaaaactatgggacacagcaaaagcagggttaaggggaaatttatagctataaatgcttacatgaaagaaacaaggcctcgaataaacaaactagctttacaacgtaaggaattacaaaaagaagaacaaactaaacctaaagctaacaaaaggaagaaaatagtaaagattagagcagagatcaaaatataaaatataaaaaagagaaaaatcaatgaaaccaaaagcaagttcttcaaaaatatcaacaaaatgatgtgatgaacctttaattagataaactaagataaaaagagaaaagactcaaactactaaaatcagaaataaaaatgaggacattactaccaattctaaagaaataaaaaagattataagggagtactatgagcaattgtatgcagaaaaactggataacctcaatgaaatagacaaatttatagaaacacaaaacctaccaaaaccaaaccacaaagaaacagaaaatctgaacagacctatgactagtaaggtgattgaataagttatcaaaactatcccaaaaaagtaagccctggatccaatgccttcactgttaaattctatcaaacatttaaaggagaactaacaccaatacttgtcaaactgtttaaaaaaattaaagagtagggaacactccctaacttaatctatgaggccagcattatcccaatatcaaagccagacaattatcctacatgaaaagaaaactaaaggccaatatccatcttaaacattgatgtaaaaatcctcaacaaaatagtagcaaagcaaatatttagcggcatattaaaaagatcatacaccatgactatgtgggatttattactggaatgcaaagatgacttaacatacaaaaatcaaggtaatacaatacgctaacagaaaaaaaggcatgcttatctcagttgatgcagagagagtatttgacaaaattcaacatcctttcaagaatatattctttttgagacagagtttcactgttgcgcaggctgaagtacagtggtgtgatcccagatcactgcaacctctgcctcctgggttcaagtgactctcctgctctgcctcagcctcagcctcccaagtagctgggattacaggcaactgctaccacgtctggctaatttttgtactttttctttagtagagacatgttgcctagggtggtcgtgaactccccaacctcaggtgatctgcctgccttggcctcccaaagtgctgagattactggcatgagccaccatgcctggcctatttgtttgtagaaaaaaaattcaacaaactaggaacataagaaaaatacataaacataataaaagttatgtatggaaaacccacagcaaatatactcaatgttgaaagagtaaaagcttttcccctaagatcagaaacaaggcacggatgccacttttgccacttctatttgacataatattggaagtcctagtcagagaaattaggaaaaaaaagaaataaaagccatccaaactggggaaagcaaaaagtaaacatctctgtttgccaatgatatgatattatatgtagaaaatcctaaagattactggattttacacacacatattcacacacacacagagttaaaaaaaataaattcagtaaagtagcaggatacaaagtcacacacaaaaatcagttgcatttatatacactcagatgaacaatctgaaaatgaaattaagaaaacaatttcatttacaataatatataaaaagaaataaaatactttgaaattaacttagccaagaaggggaagggaaagatttgtacaaagagacctataaaacattgctgaaaaaagaattaaacaaatatatctcatgttcatggtttggaagatttaatatcattaagatatcagtactacccaaaacgatctacagattcaatgtaatccttatcaaaatcccaatgactccttctgcagaaatagaaaaactcatcctaaaattcatatggaatttcaaaggaccccaaatagctaaaacaatcctgaaaaatatggggaaaaaagactcacacttcttgatttcaaaacttactacaatactacagtaatcaaaacagtctggtacaggcatagacagacatataggccaaaggaatagaagaaagagtccagaaataaaacccaaattattttcaaaaaagttatcaaggccatttaatgggaaaaacacagtctttacaacaaatggtgctgggaagctggatatccacatgcaaaataataaaattggatctttaccgaacgccatatacaaaaattaacttgaaatggatccattacctaaatgtaaaagctaaaactataaaactcttacaagaaagcatggcaataacttcaagacattggatctggcaatgattccaaaggtacaaacaaattttaaaaaatataattaataatactgaaatatacacttaaaatggataagatagtaaatgttatgttatgtaagatttacaacaataaaaataatttggagaaaatacctctaagtaacccacagatcaaaggggaagtcataagagaaatagggagacattttgttaaaaatgtgtagattgtattttttagaaaagttttacatgaaaaaaaaatgagcacttagaattcccatatatcccctgccaaagtttcacttattattaatgttttacatttggatggtacattcattagtattgaaccaatattgatacatttttgttaactaaagtccatcctgtattttggttttcttagatttccttaatatctttttactgtttcaggagcccatctaggataaaacattacatttagttgtcaagtctccttgggcaacttttggctatgatggcttctcagattttccttgtttttgatgaccttgataggtttgaagagtactggccaggtgtattcttcaatgccttactattgaaatttgtctaattttttctcatgattaagactggggttatgggttttcaggaataagatcacagaggtagagtgccatatttatccatagtatcaagggtatattatatcaacatgatgtatgacagttgatggtgaccttgatcacatggctgcagtagtgtttattaggtttctctactatgcagttattctttgtactcctctggccatactgtactctttgaaagaaagtcaatatgtgcaacccacacttaagaggtgggaaattatgatccacttcctttaaaattgaatattaacgtaatttatcaggaattcttctgcatgggagatttgtctcttcttccccatttattaacatatttaatcatttatttatatcagtatgaactcatggatgatgattttatacttcatactataatccactgctacattagattgttgttcaaattgttccaccttttgctacttagaatgagaaaacattataaattgaatgaaaataaaaacacctcaaaatgtgtgggatgcaactaaagcagtacttacaggaagatttgttgtattaaatacttgtactactgttgtccctctgtatttgcaaggaattggttccaggacctcccacagataccaaaatcctcagatgctcaagtcctttacacaaaatagcatagtatttgcatataatctaagcacaccctctctctcaaatactttaaatcatatctagattacttataatacctaatacaacataaatgccatgtaaatagttgttatatttttaaaatttgtaattttttgttgttgtattgttatctttgttcctaaaatatctttgatccatagttggttgaatttgtagatgcagaatctacagataaggagggccagttgtatttatgaaaaagaaatatatcaataatctaagtttccaccttaataaattaagaaaagataaaataaaatccaaagcaagaaggaaaaaggaaataataaagagcagaaatcaatgaaattgaaatcaatgagaaagtaagggaaactaaaagctagttcttggaaaatatcaatagaattgatacagtctctagccaaactgatcaagaaacacagaacaaagacacattttatgaaattgaaaaaaaagagaggtgatcagttaagataagacatcaaaaagttaatgagggaatattacaaacaactctagtcccataagttagacaatttacatgaatgggacaaattcactgaaaaatacaaactgccaaagctcattaaaaaaaagagagacacctaaatagtcctatatcaattaaataaattgaatattgttatgggctgaattgtggcccatatgtggccgtatttggagacagggtttataaagaggtgattaagttaaaatgaagtcattagaatagcccttaacgtaatataactgatatccttataagaagagattaagacacagatatacacagtgggaagaccatgtgaagacacagaggaaagacggccatctgcaagtcaaggagagaggcctcagaagaaatcaactttgctgacatcttgatgtttgactgctagcccacagaactgtaagatccattcttggatattttgttataaaagcacccccccaaaaaaaaaaaaaactaaaaactaaaaactaacacaaatatgtatttagaaacctcacaaattctgggtccagttggcctcactggtgaattttagcaaacatttaaggaagcaatactaccaattttatacaaacttttccagaatattgaagaggagaaaacacttcccaaataattttataagggaagcattactctgatactaaaaccggaaaaagatatcacaaaaaaagaaaattacagatgaatatctgtcatgaacataaacacaaaaaaagtcttcaggaaaatactagcaaatcaaatcgtaaaacataaaaacaatattacaccatcacaaagttgggcttatcccaggaatgcaaagcaggtgagatatttggaaatcaaccaaagtaactcatggtatatcaacaggcaaaaaaaagaaaaactatatgatgatctgaatagatgcagaaaaagcatttaacaaaagtaagagtccattcataataactccgggaaactaggataataggaaggctcccttaatctgataaatggcattcacaaaaatactacagcgaacattatactttatgatgaaaaacagaatgctttctccctaaaatggagaatctggaaaggatgtccactccctttcctcttattcaacattgaaccaaaagtcctagcgaatgcaataagttagtaagtcaaaaaaaaaaagaaagaaagaaagaaagaaaagaaatgaaaggcatatacattggaaaggtagaaaaataaaactgtgtttattcaccaacatgagtatctacttaaaaaaattccaaaaaatatatttaaaaggccctagaattaatgagcatttaggaaggttgaaggacacattggtaatatacaaaaatcaatcatatttctatctactatcaatgaacaatagaagttaaaatatttttcataagtctcatttacaatagcaccaaaacatgtgaaatattagatataaatctaacaaaacatatatacaatctatatgttaagactgcaaaacaaacaaacactgatgaaagaaatcaatgcagacctaaacagagtgaggaatgcttccgtcaggagaaacaacaacaaatccgttaaagtggaatttgagaacgccaccaggacattttgggttcctcatatgctactgaatcatcagggaaagggggattactacactgcctagtgtgctggattccaagtattaaggggaaactgggctgctgctttccaatggagtaacgaggaatacgtctgcaatgcaggtgatcctctagggtgtgtcaaggtgattaagtaaacagaaaactagaaccacccaatttaggcagaactactaatgacttagatcttgaggaatgaatgtgtgggtcaccctatcagacaaggaaccacaaccaaatgggatgtttgctgagctgaaagagaataccagacaggtgtaagacggcagtgatcaaaaccagatacaaccatgtgaccagctgcataaacagggataaaatattgtgaatttttctttcttttttgatatgcatattttatacatatatatatatcatatttttgttttcttttaaaaatattaaagggaatgtgaatcagttggaaaagaaagaatatcactcaagacaaaaaagagacacttttggagaaggggagagaatgttttcagttgtacacagattagttttatcactgtagatgcaagcataaggttgtccttatttggatattaagtaacatttaaaagggtgtatataggtgccaggctgatacagggtgaactgtgatagctttataatatgttgacatggctaggctggaccacttttcccagaattctgttctctgaatgtttccagctaaaacagggcacaagcgaggttctcatgtcagatctggaaggtgaacatggggcagcagctattctgtgctcagatgcactatggatgatctcctgactcccctcattctatatgtggaaggaagaacttaaaatcacaacagtgccaatcctacctgaatgaatataactggcatgtcattctatctaaatttcaaacaagtttacacaggaatgaacaaaataatttaaaatcaccgatgcagcaaaaacttgcccaaatagctacaaaaatgtattttttaaaaaattagagggaggattttcctttccagatatatttagaataagtagaatcaaaacagaataatataatatgtccacaggaacaaacaagtcagttagtgaaaaaaaatttagagaatacaaaaggatcaaacatttttggaaacttaatatgtgataaaagtatatataaattcatttgggaaatgtggtttacttagtgaatagtgctggtataactgtccagtcatatgaaagaaaatatagttttctatacccctataatatttagcaataaactgcagatagattcgtgatctaagcaaaataagtgaataaaaattctgaagaaaatttaggagaatatttgcatgtttttcctgtaaagaagacctttttaaacattttagaagttaagaatgttcatgaaagtctcccttcttaaggtatagaattgagggttacaatttatagcacatttgtcagacagacaacatgttaagatttccaacatgtgaagagttcctacaaattaataagaaaaacaatgaacaaagtttataaatatgcaaatccaagaagaagttaataaacatatattaagatacttgatcctagctgggcacagtggctcacgcctgtaatcccagcactttgggagaccaagacgggtagatcacaatgtcaggagttcgagaccagcctgaccaacatggggaaacctggactctattaaaaatacaaaaattagccgggcatggtggctaagcttttggaaaggaatctggtattgcccattaaaatataaaacgaacataaactttgacttaactatcttactttagggaatctaaccaaaatcaaagtaccagtacttaggaaatacgtgtaaatatatatattgcagaaaaagtcaactggagaatgggtgaatatattatggtatttccatacaatgaaatattagacaactattaatcctatgtcagaatatgtcttaacctatataataatatagtttaaattttaaaaactatggttgcagggtaattgtagagttgcagagcacacatcaatttttatttaaactttaaacagaaaatctgtttttatatctttgtgtattcttagataaactattatattggttgcctctgaaccaggattcaggatgatgggaggaaattattaactttttctctatatcattctatattgattttcactaaaatattagcatacattaactttataatttaattttttaaaattttggcttttaaaatattttattaaatgttaaataggtacaaaataataattaagtaaaatatctttaagaacaatacatacccaatttaaaacagaacattagcccctgatgctcctgtgtccccttcccagacctcattccttgtcctcctccctcagggaataatcactattctgaattgtactatcattccttttgtttgttttgtttaccctttatgctgttttgcatatttcacaaatttatatagattacattattttgttttaaatcttgacttttttgctaagactgcatctgggtttattcatcttcacattaaacaaaatacaatatctaattcatacatgctggtgttgacagatatctgagttgtttacagttgaagtctattaaaaacaagcctagtatggacattcttgcatatgtcttctggtagaaaaaggaaagagtttctctaagctaaataaccaggaaggaaattgctaggacatatggcatgtgcacactaaaaaaataccaaattattttccaaaatggtttccatcaagccacatactcaccaatatcaactattatcacatttttaaaaatggaaacaatctagtcagtgtaaattattatttcactatgatttaattttcacttccctgattcgaaattaggttggaccactttttcatattttctcttctgtgaaatgtttgttaatgtgttttgcccatttttctatttggttatcttttacttactaatatgcagtttcttatattttctaggcattaatcctttgtgagcatagacctcagtaacagaccctaggaggagcctaaccatagtcctaaactgaaactgaaaaggagggtactaagaaagaaaaaagcagtgtctatctacttttccctaggaactggccttactctaacagctaagaaatggtatttcctgtttgcaaagtaatgtgttcttatttttattttaaaaatatatttatattcaaaattccacttctgcctaaatatagaaagctagtatgagcatcactcctaccctaacaatatacataagttgaaaaaaaaacactaaatcaaaattttattgaacccattagagagctgaggttgcagggcaaccaagtagtctgcaatctaaggaaagacagactctcctaaggagtgacaggacatgaacactggctccctgtggcagttcaagggagaaagagataccaggcactatacaaatgggaaagaagtattcagacataaaatgtaatgcactgctgatagctggatgtgggccagtgtgacagtacagaacagcgtaaagccacagacacaaaaagaacttgcacacattcacagactcaagttcacagacctccaacaggtgctcataagaaagactgagagcagagcaggaaacgggaagaaccattccctcagaagggtaggcttggaggaggggagccactgtcatggtcgaaaatgcgtaaagccccacttagacctatttctcccagaacaaaagccttacactgcaggaggaggagcagcaatccctgctttgtataagtgtatacccactgcagttggaaacagagcaaacaaaatccatctattcctggagaaggtgcagaaaacagtcctaagcccaggatttaatgccattattattacaaaactcctaccactacactaagtgaaggggaggaaaccttctccactgtagacttgccaaaggtgtcaggcagagtctggatgccatgagaaggggtagtatcactaaccaagcctgtcactgaggaccagggacagaggacctgcccaaggctgagaatggaataggacaacaaagaatgacttggccctccctccccaggcacgcaagcaccagtctactgctggaagataggcaggagaaggaaagaaagcccttctaaagcacaggcacacaggggaggcctaaagctgaggacgaaacaggaagagaccaaaaataaaaactccttagcaccccagctgacaccctgcgcacaagctaaatcctaaggaattctaagccaatggttcaccataggtaatgagagcaacacaaaaccaaaacccagctcatgtcctaaatggcctaccagaggaataggcatgactatttctaggcataaattctatttactttagtctctttttttctacacccagtaccaacactcaatcagatatatagacacataatgaagctgcagcagctgcaacaacagaagccagtgtcaaaaagcaaagcaatcacagaaaaaaatatcagcaacaacccatctgtcagagttatccaccagggaattttaaataactatcattaacatgttaagctctatgaaaaatgcaaacaaaacgcattaacaacagagacggaatctgtaagaaggtgtcaaatggaaatgttgtacataaaaaacactgtgtgctttcaatgggttcattagtagacttgacacaaccaagaaaggaatcagtaaacttgaagaaaggttgacagaaattacctaactgaaatacaaagagtaagaagagtaggagaaaagaaaagtaaaaagcaacaaataatgttagtacagcttctttggaatacagtttgtctgttatacacttatgacccagcaatcccactcctagatatttaccttaaagtaatggaaacttatgtttacacaaagtttgtgaatatctgtagtacttttatccataattgccaaaatctggaaacaacccagtgtccttcaactggtgaatggaatactattcaataaaaaagaaattaaatactgataaatgcaatgacacagatgaatatcaaaagaattatgctaagtgaaagaagttggactcaaaaggctacatatttatgattccatttatacaataccttgaaaaagacaaaagtaaagagaatgaaaatagattactggttgctaggcaccggtggtagggtaaagggttaactataaaaaaatacaagagaaatttggggggagatagaaatgtactataccttgattgtgatggtaaaccttggtcaaacctcatagaactgtatgctaaaagggtgaattttactgtatgcctcagtttaattaagcatgttttaattaattaaaaattatgtctcgttttataaaagcatattcttataaactatttttgtaggagatctgcattttaataattgcataaggtgatattttcttaactggatttgacatttttcaaataaagtcattagagaagatgtttccaacatttgatgggatgttggttatggatgacctctaagatcctctccaactccaaggtttttgaggtgtgcatgtgatcccccaagtttacaaacacaaattttataaatatatatatatatatatacacatacacatatatgttaagtatatattcatagttctaattacatttatattatatatacatgtaaatacgtatacacaaaaagttctgaaatattcttcagtattataatttattatatatttgttattttctttttttccactataaacatgtgataatttgtaatccaaaaatgttattattttacttacaaagcatatattgtgcaacaaatttttaaaaaggaaataaggaagcaggttatttttcaaatctataaaatacctagctttaaaaaaatggattttactaaactgacatatttaatactttaaaatacttgaagaaaggacaggaattagccattgtgaatatggggtgtggagcatttttttaattgcatttttttatttttaaaagaaaatcctagaaaaccatattttcccatttttgaagttttccctagctctttctttcatttgtattagaaatatctttgtgcatatctctaaaatagagcctcaacttgctactacaaataggatgatgtcataccagaaagtagaggggagagagcctgtgatggccctgcagcctcctcatcctcactgctccacctgtctcttctgaaggggcctctggctgtccacatgctgggatcactgccactagaaaagaaatgtatatatttgcccatggtttcaaagaatatatacatttgagaaatactttctaatcatcttcattgattatttaattgacattcatttccatttcaattcagccacccactcccattgtcatcacctgaaactggcccacttgtgaaataattcccaaatcccaatatctgatcacaaactccatctcctcctactacttttaccttgcaaactagtcgcctcagatccatccacttatttaccttctcccctcctttacctagactgtgggagggaagtactcgggtcactgggctttctaatatcggcagagagccgtttggaaaataccagcatgtccctggttggtttcctgtaccactcttccatggcagcaaattccaagccaccatcttgttatagtccttattttaatactctctctgacttagtaaaaatgtaacttcttctagaaaatgcaagccagaaaatagaaattctttcaatttattatcttttaaaacatttacttagatgcatcaatgtctttcttattccttgctttctgcctgttcaaaattcctccttccgtgttcttaaccagattccttctgcctcctctaaggtatttttctataacttatttttttttaacatatcgtgaatttctccctatctacaaattctttcatatcataagaatacacaattttctgtatcttaaaaataggaaatgctttaaactctgtctagctactaattgttaacagatttttcaaatcctagcccatacccactttgtttcctttgcaacgtctccatactcaactgactcgctaatgctattaacttggctcttgttgcactttcatttgcaaccctacctagcaaaatcctcctaatttgacttctgcatctaaccttcaatgtttagagaaaattcttcctaaaatacaaacttaattacacctgcccaccaatatcaggataaatcaaggccccttatcagacacaaaagtttaggatattggccaggtggcctctgtctatttttccatcaccatctccactgatttcctacatgcactgtatgctttaaccttagcaaaataagtgcctttttcttttacttctgtaagaaaattcgggtttcttactcttttctccttctaatttttttcttggattactgtaaacatttaattaatctccactgactgccacttccagctatcctcaccttgccaccagcattcctccttctggatggataaatagatagttgcatgaataaaacaaaaagaccctccgtatgcatccttttgattttaacagactgaataaaatgtatactcagcttcacatatatggcattacttccctctccagcccacactgtattttgggctccacctctcatcttctgcagcttcctagcattccacctcacatacaccctacgactcttggcacctaatatttctccccattacccctaagatattttcacaactccttaccctcgctcaaacttctccctcttgcctgaaatgttcttctctttttcacctgctaggtttctatttaattaaatcctaaattcaaccaaaatatcttttcttcaaagaagcttgtgggaaacctccctcatgcatagtcaatcttctgtacccacaatctttggatttttactctaaaataatatttactatgttgtacatcaatttgtcttttatatgtctgtttccctaattaaactgtgaactaaagagcaaaaaatatatagtagtttgtatttgtgtacagtgcttagtgtatcacagaatctcaaaatgtctttggaattactattatttgtttaatgcacttctgaaaattgtacatataaatttcatacaatacgcatacaaaaacacataatataaagaatatacacattcttatacagtgctattccagtgagggtagctaatattactgataaatctctaagaaaatatggcttaacaaaatgtttcctcatttgatgtttttgcttataacacctaaatttgaacattttataagcatgaaaacttgtttctttgttttcctaatggaaatttactgttcttcaggtactttaaattttttaaatatatactaccagaaattcaccatactaataaacctgttgtttataccatataattttctttctgaaaacagattacatttctaataacatttagtgctgtaccgtgagcttcatgctacctcaagtacactgaccacttcaaaagctccaagcatatttgcaaaagctttgacgccatgtaactattgagaggatagagaaatcgaatccttcaagaatacttttcccttatgttaattaccatatttttgagatcataaacatatttctaagaaagctaaatcaagtttataaaaagctatatcttgaaaaattaaacatttcagggccattattcactgtctccatgcagagggctagctatgaatataagtagcataaacagaaaacccactaaataagcatattagttatacctttctgaaggctcttcaaaaacatcctcataatcattatgtgggaaattccgaagagaaagttttaccttctctgaattaactttattttcaaaaacctacagacataagaaaggaaacaaattatagcactggttttagaaaaatatggtttaaaacgtgatttctatagctacttaagaagagcaaaaagatctgcaataatggaattataaccacaatcacatagtataatgtctgctcctagaaaatcacttaattgtatatctccctattaaatatcttccaatctgtcaaaacagtgtagagtactatgtaaacagaagttatttatattgaattgctcaagtgatttttcaaaactaaatttttaaaaagcttcatttgagaaaaaatagatttattacttcagcccagaagagattttcttataagtgtttaccatgttttgtttactgtgaatataaaattcctgccactaaatttatctttactttagtacttgcaccatctaatctactaattctaagtatttctccacattccactgcccaattttgcaccgggcagtggacttcagtcttgataactcgcagtgccagtgccccagccaccacatacacgtttccttccttccttgtctaatactgtcttgccatacttggccttctattttctcaagaacatcttttgaatcagctgatcaaatctcattcacacacagaaataactttgggactattattgaaattaagtaatatgaattttttaatttaaattggaaataagtgatgtatttatatattaagtatcattatccactaatatgatatagctatccagcaaaaagattataaaatattctcaataaagacaatgtataccttttcttagatttactcctaaacaccttaagtggcacaattgtaaatgtaatgtcatagagcagaccttttatttgatacacactgctcaatccacaaaccacatgtttttacatctagtatttttgtgtacattccattctaaatactttaaacttccattatgatttcttctttgactaatgagtttgttagtgtttgcttggtgtatgtttaatttttactttaaaatcacaggaaaatgtccacctaagattccttctcattaaactatgtagctacaatacacgaaatgaaatgagcttcacagaattgaactagttttgaaatcagcactgattggcaaatccctaaaaattaatttcaggataattaaaattgaaatgtagaaagtgtggctccagtgggatggaggaaaagaagtgggacacatgctattacacaacatgatcccacttccctcttacgagacatgcttaaaagtcatttgagtacaattcatttacttagaaaaagtgatatctggaagtcctaacacaatttaaacctgagacatctttcagctcatggttcaaaatcaaatggattatatttattttttaaagaagcagactgttccagatggctgcaattcaaatttaaggctgactaacatatgtctgattgagtgaaaagtgattttgctaacaataccaagaactaacaaggagaaatataataaattatcaagatggcaggacttttggagattgctcacggaatcaaattaatatcaaattttttaaatgttagaaaatgttttctgaggagcctaagttagcttttctgtagtccatgcagcaaggatttatgaggacaaagtgaaaacagtaacacagataggagcctggtttctagtctgtgactcaagagttatatgatcatagacaaatcgcttcagctttcacctctaaaatgagtgctggcataaaaatgtctttaacaggccaggtgtagtggcttatgcctataatcccagcactttgggaggccaagacgggtggatcacctgaggccaggagctcaagaccagcctggccaacgtggtgaaaccccgtctctaccaaaaatccaaaaaataaattagcctgtctcaaaaaaaaaatttctttatgctccaaatctaaccaacttcaagtctatgagtctagacaatttctaggggacagcatcatatctgaaaggacataaaaatggctacagtatcaaattgtttcatgaaacataagaaaagcaagttctaataaaatcaggtaattttcccaacactataaaaaccatccaggaatgttctaagatccttttttatgaaaggaaactttaaagcatatcagaattcaccctagataggccaagctataacttagcaaaaaaacaaacaaacaagcaaaaaaaaacccaaagtaaaaatataaacaaaatcacaaaatgtgctcagttctagaagaagtcaaataagactataagactatataaaggatatacttgggccattctgtgaaggtgctccctttcaaatcgtctctgcttcaaagagaaaaccattctgatcagagaaaagaatcaagagtgagcggagagcccaacacggcactaacagccagagattcccagccaaagatgtgatggtagccttgatgtggccaacttaagtatagcagagaatggacaggagataataatcaagttacaacactgttcttaaaagctgcactcctgcccacctggggtggaggtggcaattgaacaggggaagtggtaggagcagtttttggtctatgtactgactttatctctattactcctgtaacttacaggaaatgaacacaaggccagcatcatcatcgcagttccaaagctccagttgactaggtaagagaaaaaaaaatgcaaagcacccaccagactaaaatgcatttccctttttttgtgctctaaccctagcactatctccacaaatggggtaatgtgttgaagtaagaggttttgtcacagacttttcacagccctctacttttccatagttcggagacacccaatcatgctgtctcaaacaatgaaaaagtccacaatcaatacatctaaaggtgcttcatacttcatgtgacatttattttgtatcttcattagtaacacaaaactagtgcctgtaaaatttccagagtagcattagaaaatgcaattcattagaaactttgcaaaaaattccactctttcaaatccccattttggtcactgtcaacactacagtgacaaaaaattaagaaatcattttggtgagaaccaaatagatacccatttcccagagagcacagtcagcaatttaggtattagccaaaattagtagagatccctctccttttagtcttacctttgatctaggtgtgttttcctgacttgatgaaggcaaagtctccctgaaattcaagtcttctgcttcagagtcatttccctcataatcgtttactgaacaaaggcggggggaaaaactgatcaaatagaaaacactatacagaaggaaaaatggagccttaatgagaaaaaacaagctacatgaggggcattttcatctacttttcctgttttccaaacaccccatctttatctcctatggtaatcatctctttctcccctgctttgaaaaaatcaacatagcaaagctgatccttcttctaggattatcctcagggagttgacttttgagcggttcccttgttcctcattgccatattattcaagaaagtactcttcaagtaaatcctagatatttacaacctgcagaacctatgcattgggatctacagaatacagtcttctgtgtttcagagtctatttcttgaataaagaatactgtgttacaaatgtcgcactgtaacttcttgtattatttataattcataagttagtaatatgttaaattatacagaaaattgttttcggctttgttgaataatgtaatatgaatcatcccaaggaaactctgggtttcttatatgattattcctaattactgtgttaattttactgcacagactctttcagataagaagccaagagaaaattttctctgatctcagtactgagcactcagagtactgtttctcataccatgggagccttaaatattatgatttagaaattctatggcatggcatattaccaaatcaataaaaatatagtaaacaagtactatggaaatgaaaaagtgtgttcctgaatgtgtgttaaaaaggaaatctaatagaaattatgaacctttataacacatgaattaattttataaattaaaacattaagaaatatcaatgaagggacaacatatcaaaactaatgtgaagtagctaaatgagtatttagatagagggaaaatgtataggtttaaatgtgtttacaaaaaaggcagaaaaaaaaagctgctataaatgagttttgtattcaatcatagaagccaaagaaaaactgaggaaacccagagaaactacaaaggagaaaatcataaagaaaaatataataacagaaaataagcctaaagaataatcagcaaaatccaataaactagttctttgaaaaaaaaaacttaaaaatacgcaaccctctttcactacaaatcaatggagagtaagtgcacaaataacattaaaaatgaaaaaggatcgcttctcggccttttggctaagatcaagtgtaaaaatgagaaagggcacagctacagatgcaactctcatttttaaaggtaataagcaaatattatgagaaactttagggaaatctgatgaaatggaaacttttataagagaattataagttatgcaaatttactccagaagatgtagaaagcctaaatagtgtaataaccatttaaaaagtcaaaccaataatcaaaaatatcactcccaagaggaaaaagcatctgggcccaaacaggtttccagatgggattttatcagactttcaatgaaaaaaatctctcatgcaaacggttctgaaaataggaaattccgcaaacctaggaaggagcttcaagtgctagaaaaaaaattaacaggaaaaaaaagtctatgagaattgtaaacaagcaactcatagaaggcgacttacaggccaataatatattcagaaaaagtccagcctcacctgacaaacaaaaaatgaaaagtaaaacaacctacaattgactttcatttatgcttatgagagatttactgtaataggacttaaccacaaccaaccagaaaataggacaaaatatataaaacaataattttcagaccttaaacaacagactgtgatcccagagagaagggggtgagccttctggttgctccagattatggcctccagaagtttgcaggctatagctcaggaaaggaatcaacgagtccagtgattcaatgagttgagaagaaaaagatcaaagttaggagaggctgaggcagccagaatttgtagggcagagtaccagggaggagggagctatacagaacaagagaagtctaagtagctgcaaagaaaccctctcatgtcctttgcagaatatggatatgcttatatgaaggaggacaatctctgacactcaggaaggaccaccggaaagtagcaagccacacaattcctaggaacagttcataggagccagaatgaggagaccctgtaatacagggggcgttgaggatagtgcacagaagagatacctcttagtactaaaactatccttggaacagaagctccttagggccacctataaaaaaggtgaagagcaagcctcagacaggatcaggttaaacttcaagtaacataactacaaggcagaaaaacccaacattctttaaagaaaaatcaaggccgggtgtggtggctcacgcctgtaatcccagcactttgggaggctgaagagggtggatcacgaggtcaggagttcgagatcagcctgacaaacatggtgaaaccccatctctactaaaaatacaaaaattagctgggcatggtggtgcgcacctgcaatcccagctactcaggaggctgaggcaggagaatcacttgaacccaggaggcagaaggttgcagtgagccaagattgcaccactgcactccagcctatgagacagagtgagactctgtctaagaaaaaaaaaaaaaaaagaaaagaaaaagaaaaaagaagaaaaaaagaaaagaaaaagaaaaaatccagcaccaaaatcatataattcacaatgtgtagtaaacaattaacaggtatgccaaggaatagaaaagtataacccacagccaaatcaatcaatcaatagaaatgtacttagaaatgacagatgataaaatttagaaaaaagaacttttaactattataaatttttaaaaggtgctcaaggaaataaagaaaaacatgatacaataaaaagagatataaatcatgtaaaaataagacctactgaaatttctagagacaatgtatgaactaaaataaattaacagcagataaggcagaaggaaaaaaaatcagtgtctgtcaacatacagcaagagtatatccaaaatgaagcgcacagtagcgaaaaaaagagactgaacagactcagcaaactgggacaacatcaagtgaactaaaattcctgtaactggaatgccaaaacaaatatgaagaaataatagctgaagtgttaccaaactagatgaaaactataaaccaacagaccaaagaaggtcaataaaatacaaatgtaatatatgagcttatagaaaaatcacattcatgtatgtcatattcaaattactgaaaagaaaaaatgccagagaaaacagacacattaaatatagaaaaacaaagataagaatgatggatttctcatcagaaatcatgcatgctagaagataatggtgagacattttaaagtattgaaagaacatagaattcttatagaatgtcaatatagaattctataccctgaaaatatatatttcaaaaaataagacttctgtagaccaataaaaactaagattatatccagcctgcactaaacaacaacaacaaaagttaaaggaagtttttcaggcacaaggaaaaggataaaatatgaaaatgtagaactatccaaaggaatgaagagtggcaaaactggaaaatacatgagcacataaaacatactctttcacatgttctaatttctttaaaagataactcaattataaggaaaaataataatctattgtagggtatacaacactcacaataaaattggtatcaataatagcatgaaaggcaaatgggaggaaatggaagtatcttatgttcctacaactatatgtgaaatggtaaagcagttcccgcttacccacagggaatgcctagttccaagacccccagtggatgccgaaaacttaggatagtacttcctgcactgaagtcttaaatccctcaaagtcatccatgagggttaaaatcagtttttcccaaactcccattaatgttgacattttgacctcctcccataaaccacaaatgttcttaatggcgtctagaatggggagttatttccaaaaggttttcaatttactttgcccagagccatcagaagaatcactatctatggcagctacagccttacaaaatgtttcttaaataatgagacatgaaactcaaaattactcattgatttctaggctatggaatagatactaaatcaggaactaactcagtaatttaaaaaaacctaccaatcagaaagagcccgggccagaaggattcacagtcaaattctaccagatgtataaacaagaggtggtaccaatcctactgaaactatttcaaataattaggaagagggactcctccctatctcattccataaggccagcatcgttctgataccaaaacctggcagaacacatggtctaatatccagaacttataatgaacttataaatgaacaagcaagaatcaaacaaccccgttaaaaaatgggcaaaggacatgaacagacacttttcaaaaggagacatacacatagccaagaagcatatgaaaaaatgctcaatatcactaatcatcagagaaatgcaaatgaaaaccacaatgagataccatcttacacaagccagaaaggctattattaaaaagtaaaaattaaaaaaaaaatgtttgtgaggttacagagaaaagggaacacttatacactgctgatgggaatttaagttcaaccactgtggaatgtggtttggagatttctcaatgaacataaaacagaactaccatttgattcagcaatcacatcactggctatatgaagggatataaattgttccgtcataaagacatatgcacatgtatgttcatcacagaacttttcacaatagcaaagacatggaatcaacctacatgcctgtcaacagtggaatggataaagaaaatgtggtgcaaaaacaccatggactattacacaaccataaaaagaatgaaatcatggctgggtgcggcggctcatgcctgtaatcccagcagtttgggaggccaaggcggatgaattacctgaggtcaggagtttgagaccagcctggccaacatgatgaaaccctgtctctactaaaaatacaaaaattagccgggcatggtggcacacgcctgtaatcccagctactcgggaggctgaggcagaagaattgcttgagcctgggagatggaggttgcagtgagccgagatcgtgccactgcactccacctggctgacagagcgagactctgtctcaaacaaaaacaacaacaacaacaataaaaaaaaaaaacaaaaaacagaatgaaatcatgtcctttgctgcaacatggatgtagctggaggccattatcttaagtgaatcactacctgggtgatgagatcatttgttcaccaaaccacagcaacaagcaatttgcccatgtaacaaaccttcctatgtacccccaagcctaaaataaaagttggaaagaactagtctacaaaaaagtttgggtagctttccatgtttttgcatattctagcttaactgatttatcattaaaattagctttttcataaaagtttgcaactgttaaaggatagtttccagaaaaagaaaatcacagctctcatacagacatataaatgcacatgttactttattatattcattaatcagtgagggaatcaggcagatgttatttttaaatttttttttaaaaaacccataatactgtgtgttagtctgttagcatcactacgtaggaatgtctaaggctgggtaatttataaagaaaagaggtttgttctggctcgtggttctgcaggctgtacaggaagcatggtgctggtatctgcttctagtatctaacctcaggaggcttatagtcatggcaaaaagtgaatgaggagccagcaaatcacatggtgagagacaaagcaagagagaaggggaggttccagactcctttgaacaatcagatctcacatgaactgagagagcactcactcatcaccagggggataacaccaagccattcacgaaggatctgcccctatgatccaacatctcccaccaggttggggattacctttcaacatgattagaagagataaacatccaaactataccatacaggaagtccttgccagagcaattaggcaagagaaacaaacaaaaggcatccagattgaaaagaaggaacaattaggcaacagaaacaaataaaaggtagccaaattgaaaaggaggaagtcaaatttgtccctgtttagagatgacatgctcttacaaatgcaaaaacctgaagaatccaccaaaaaactcttagaactgataaacaaattaagtaaagttgcaggatacaaaatcaacatgcaaaaatcagtagcatttctataaaacaataacaaactacctgaaaaagaaatcaagtaagcaatctcatttacaataactacaaaaaataatacctaggaataaatttaaccagagattaaagatctctagaataagaactataaaaaattgatgaaataaattgaggaagacacaaaccaatggaaagacatctcatgttcatggaataaaagaataaatatttttaaaatgacaatataaccaaagaatctgagagctcaatgcaattcctatcaaaataccaatgacattcttcagagaaattttaaaatcataaaattcatatggaagtacaaaaaatactccaaatagccaaagcaattctgagccaagaaaaacaaaaacaaaataaaaacaaacaaacaacaacaacaaaaaaacaagaacaaagcttggggtattacactacctgacttcaaaatacactacaaatctatagtaaccacaaaatcatgatactggtataaaaacagacacatataccagtggaatagaatagagaacccagaaataattccatatgtttatagccaactcttttatgacaaggcacaaagaacatatattggggacaagaaagtctcttctataaatggtcctggaaaaaactggatattcctatgcagaataaacttagactcctatccctcatcttacacataatctgacttacagatggaatccaggctcacaaaagcagatagcagaatggtggtttccaggggatagaggaaggaggaaatggggagttgttggtcagatggtatcaagtaacagttacacaagatgaatacgttctgaagatctgatgtatagcaaaatacatacaatactgtattgtaatgatatttgctaagagggtagatcttatgtttgtaatacacacatacacacaaagaaagaaaatggtaactgtgaggtggtggatatgttagcttaattgtggtaatcatttcacagtatatagacaaatcaaaacatcaagttgcacaccttatgtatacacaatttttgtcaattatacccgataaggattggaaaaacacttctagggagagagcaataataatgacaaggagggcggatagaagagggaatagaagctgggctgaaggtggaaggaatgagaaaaggcataaaagacatactgaaaaatgatggcaagctactaatgttttaagcaagacaatggcaatatgggtcggctgggagacagctgacatttaactaaaacactgcattagtagatgtatcaaaaaccttagaaatgtatatgccctgagttcacagctaacaaaattatggaaacaaacagctttgtggcagattacaggttgtttttattgtcttgttgttttctttgtgttttggtgcttttttgtacttcccaaattcttcacaataaacctatattacatttataatcaggaaaaaaaaatgccatttgaaaagggtaaagtaaaacactagagtttaattgttgttactctaagcgtgatggcttattagaaatgcagagtcttgccccccaccccaccccaccaagacccagaggatcagaatatgcaggataataatccacaggtggtccctatgcaaatctacagtctgagaggcactcctgtagctcctcctgatcccatacccacaaaagtagatgatgcacctaccaggctctgctctaaagtccctaggtgaagacatgttgttcccatcccctaaatgagactggtaaaaggcttcttcagaaaaggagccttagtgtcctgtgagtcaggccaaaggtctagttagtatcctgggggccagcaaacaatttttgttcacctggtaaaacacacaaagccaaagatttttctgttacacaactggagctatcacagctttgacatattattactcatcaattcaaaatatttaaaactgcaattttaattaaagacaaaataaatttcatttgaaattttatcaaataatttcaggatattccttgagaactggagatacgcttatttattcaaataccagagcttaaatatgctataccttgcattccacaaataaatatgtgaatggcccctccactccaatgatgtatctctttatataaacacacacacacacacacacacacacaaattcaatcaatgtcactcaatggaaactcagttatttaaatgccacacctaagctaaattaggtgctgagaattcagtactgaataaataagaattaattacagagaccgtcttcaaggagttcttgttcattcaatctataaaaagttctcacacagaataaatcttttttcttttctaattcttgccataaagggcctgtaaggccatgttacattgctcccattggttaaaaccaagaatacttttatctggagacctttccattaactacctgcaaataaaatggtattactataatctgaatctaaagttaatgtgtgaaacagatttattttaaaaactttgagatataggtgttaaaaaattatttaagactaggtgtagtggctcatgcctacaatcctagcactttgggaggccaaggcaggaggatcgcttgagctcaggagtttgagaccagctggggcaattgggtgaaaccctgtctctacaaaaattagacgggtgtggtggcacacacctgtggtcccagctacttgaaaagctgaggtaggagaatggcttgagcctgggaggaggatacagtgagccaagatcatgccactgcagtctagcctgggcaacagagccagaccctgtggcagaaaaaataaaattaaattaaattaaaatgtgaaagtaaggcaaaagataagtggaatgtcacttcaatgtcataaaataatgacaggccatcccaaagattacttatgtggggaaattgtactttattcagttcattgtttactactgattaaaagtcctagacttaatgcaattacaacgtaacctatagatttttgtccagcagtgatacaaataatttctgtctgataaggtaacactaaagattataatttatttctgtctggcattaaccaggttttcttaatctaatctagcattcttactctaacattggttcaaaacgccagtgaaaaacctagatcctcaaactgttctttgaactacctttgccatcttcctggtttcttcactaattaatacattgagtaaaatgtttaacctggtttcatttcaaatttgtgagtcacatttataatttttaaaaaactctgctttgacaaggggaagaatatcttttttaaataggaggagggctaggcacagtggctcacacccgtaatcccagcactttgggaggccgaggtgggaagatcacttgagctcaagagttcgaggccagcctgagcaacccagtgagacctcatctctaccaaaaattaaaaaaaagaaaaagatagccaggtgtggtggcactcacctgtagtcccagctacttgggcggctaaggcaggaggatcacttgagcccgcaagatggaggctgcaataagctatgattgtgccactgtactccagcctatgcaacagagcaagactctgtctcaattaaaaacaaaaacaaaaggatggcagtgttcttgtgactggcagtgaggtaacagatttcagtaaggagccttccctggaagcagacatgagatcttaaggacctcagaattaactaagaacctctaagaatgacacctaagcttctgcctaccaactatgttattgaaaagatacaaaatagtacaattttaattaaagacaaaataaattttgtttcgaattttatcaagtaatttcaagacactccttgataactggagacactcttactaattcaaatactagggtttaaacatgctataccttgcattccacaaataaatatgtgaatggtcctttaccccaatgacttatcctctttatataaatacacacacatattattaagacctctccagtgcacagatgaatagactaaaattcatatcaaaccataccaatagtcagttgttcaaaccttccatcagaacagctttgatcagaaatgcatgcctaatcctagtattttaataaacaacagtgcagtgagtcacagataaccctacagaagcacaagaattaaactggataaatttccctttcctggcatgttttctagtatatcttaaaatagacaaaacaaagcaatattaaaatcattaacatttaattcaattttgagttgcagctactgtagtaaaccagtaataagatcatacaagtcaacatcaacacatgtgtactgaaattttaggtagcctagaaaagtaaactatatgataaaaacaaaatcttcatttgcagaagaaaacctttcagaaaatatagtgcaagcttttaccatatttcccacctcccctcaagcttggctaagtaagcccctgcaagtgcttcccctataagctccatgttttataatgatttctggactcatctcctcgggttggaccataagcatcttgaggacagaaactgtaacattttcacttttcaatctccagccactagactaacacaatggagacatggcaagaaatgtttgagggactaattagttaaattccataaagaatgtgtatgtatcaccaggtaactaatctgcatgtccacatcaagaactctgagaagtcacagaggtaccacttgagtgataggcactcggtcccttagggaaagattgtgaaagatattgagggaccagtggtcaggttcgtaagataaaggtttccctccaactcctggggaaggtgcaatagtatagaaaatagagaattagccctgataaaagagaaatccttaaaaaagtattacttattctgtgatagagcactgaggaaagaggaacaaaagctccaatatgaaacaaagtgatcccatctaatcataaataaaagaaaaactacaagtgtttggtttgctcaggaaacaaaagcaaaacacctttcctcaggtggcagggtgacataattggagagtcactgaatactgtacatattctcaaattctcagctgggacactattttcagtctatctcaaactctctcaaaactgaagcaggtgctaacaaagactatttcttcacagtggactttgggttgggtgcaagatgccaaaatagacaatgtaaaatgacatgctcagcaccttgggcctctggcaattcttagcaccagggctacttctaattcttgtgaaagttctatcatacactactccctgagacctatactagcctgaagagaagggaatgaaagaagtctcaaatgttcaatagtgacttactcttgccctacctgtaggcaccccagggatatgagttccttcctctgaaatctgtatttcctgtgactaaattctcagtacaagcttcttagactactagtaattatttggcatgttttatgccttttaataatggctcttagttttctataaggaatggtggtattgctttttctgattataaacataaccattaagaaatgtcattccgtggtttcttaatcaatcattccctgtagtgtgtgagtataggactgggggctcagagggaagcagggagaagtgaagtgctaaagtgctacctccagagccactgacagttctgcccaatgcaatcaggcaaaacaagaaaaataaaataaaaggattcatattgggaaggaagaaggaaaaccatctttacttgcaaggttaaaagctttatacataattacacctcaataaagttgacttttaaaaagccacaaaaagataatgtacttaaattaaaataaaatacagaaactctaggataaagataatatcaagttattaatgcaagtttaaacattaaaaaatagttgctacccactcatcacagacatgagcagcaagctcattaaagattactgtgagcattcattggaataatggaagactcaaggttccaaaggcactgagaccctatatcaacaatgcttcacccttgaaacccagggactgatgatgatacagttgccatgagctacattctgagtaaatactttatcaattattagaacggttcaagtaaaagtaatgaatgacttaagacatctttctgaaatgactcttttatctggatgcctctgctattagggtgcaaggcaaacaaccttctactgtttgtttcattcatgatataaattgctttggcatattccctccaacctcctgaacctcaggtcgatctgtttgtccatttgtctgtttacacttcttttcttccctccttcctacgttcctctccctctcttgtggaagtgtatcagtaattataagagggtgctttatttcagaagacacaattcctgtacctccaatcactgttaccaagcaaaagagttcactgttcaatgtgttagaagccaatactatggcactgggtttttgagaaaagaaagacttttttctaggtcaaccaacaaggagacaggagtctagctcaaatctgtcttcctgtactgtttttaaggcagtatttttattagaaaatgtgtagggagtgaatttggggatagtaggagattggtagaaggaaaggggggtctgaaaaggctttgggcatttgcagtatctcttcatgctatctcatgggtcacatatgtaaattcagggggagttagtacgaaacatgcagtggaaatttgggctgtggcgtcagcaagctcattctgtgtagactctagtttgctgtattggttccaactgatttcagccagttttgttatcttaaaagcagagagaatttcagtgtttcagaaagttgtttttgttttttatttttatgaaccaatcctataaattcaagaatttctctttgccactggttaactctttggggcacagtttcattagtagaccttggcctccatactccaaagaactacttatctactgggtgcagctgaaccatttccataactgagatcatgtaagtcaggaatgtatacacattacacatgtgtgcagacaaaagttcatgacttcacctaccaggtccaagacgagtctccttaggaatgcctgcatacaagcctggcccttggctggtgtctgggaacttggctggtaaaatcattgcctacactaatataaattttttctaaatgagaaaagtagctcacttctcctaaaacatctgttttccttctaggtatctggaatttcagtgactgctatcagtcacactgacagtctgtgctcatgactaacccctgataaaaaccctaaactcttaagctcagacgagcttccctgatagacaacacttcacacaagtttccataccttgttattcagaaaattaagtgcatcctatgtgactccacaaggagaatattctggggagtttgtatctgatatcccttgttgattttgctttctaccttttcagtctaccatatcttagccatgaatgtgactacctgctgaaccccatgaatccttctatccaatcgttgaacctgggagagctctgacaaaggctagcatgggaaaatacgttgtcttcctcattaacagacccttcttagttatatctcactttctaagttcctgccttccacttcctaggagagaaaaaactacacagcattacctgaacatcatcccagggtaatcacagagcagccatctccgcaaaagaaggaaaaatgaactgtgtaatgttgcaatatttttaactgcaaataattttgcatacaaggcttacctacaattgaccatttttgcactaaatgcttttttaaagtaacaagctaatatcttcttaatataaaaatatacatgtccaacaaaatttaacttgttctgctatcatgaaaagaggaattccagacaaatgtctcataatgtgcagtcagtgggcttatataaataaggactaaaattacaagctcaataaaagatcatcaaaccagggaaaactccaagtaaaattataatacacagttgtccctcccacctgagactcacctgagactcatactttccttccaacatgcctgttctgcctattccctcaagactcagacttcaaatgagttccctttaagtagataagaacagtttcgcaacggattccagaaaaaccaatatgccacctaaaggacaaggaaggcatctacactaagaaaatgaaaagaagtcagagagagaacttcctgacttactcagattatatacccatgggtccacatatgcctaaaggccaaccttgtccttaatctttagtcactcaatctataaaataaaagatttagaaaagggctatgggcaatatggatcttttgcaggtacaaaattttttaagtccataaactttctctttaaaacactgaagaccattagtgatggttataatattcttgtctgaactgagagctatagtcaggctccttttagaagccctgccatgaacagagaaaaaagaaaaggcatgttcctactcctctatcctctgtagacatcttctccgtgataagttaataatgagaagagaaaaccaaccttctagctttctcatcatttaatggtttgaaccctgagtttctgcagcctggaaaaaaaaaaaaaaaagaggaagcagcagcagcagcagcagcaagttctcctcatctgaaattcttccctctcctagctcaccttccccaccttctcactcctttgtggtcctcacagtcagatatgaggtaataggtggaaaatacttccctgtgataaggcagtgatgcctgagccacccacttctggtaagaaagctgttcctaaagaatagcaaatggtactcatgttttgggggactctatgctacttagaagcgagtggctaaagttgcacggtgactaattcaagaacaaacagaagaaaaggacaaacagaaaaataaacagaaagaggcatgcccttagcctcaatcaggtagttctaagaaagtgattaggatggttcggagaccaccagccccataccttatccagtcaccaaacaacccaggctggggtgtggttgcctggcaaccacaccttccatgtaccgagtatgtcacaaatatgtctttccggtgtgtgatctcttgactgtgaaaagtaaaacgctaaatcaattcagcaggctttgagtgtctacaatgtgctagtcactgtatcagagatgtggatccagggatgatgcaataacttctgcctccaaggagctcatagtttagtggacatctggcaaagtactcactgattcttgacaattcatataatcatatcaatagatgcaaaaaagcatttgacaaaatccaaattccatccttgatttaaaaaaaaaaaattcttagaaaactaggactagaggcaaactttctcaacttgataaaaaatatctacaaaaaaaatctacagggagaatctagaggctttcccctaagataggtaacaaggcaaggatgttctcttttaccactcctattcaacatcttatacaacttctgactaattcagtaagaaaaggcatacagttgaaaaggaaaaaataaaactgccttgcttctcagatgacataaatgtctatataaaatatctcaaagaataaacaaaaacaattagccacttaatctataaaataaaagatttagaaaagggctatgggcaatatggatcttttgcaggtacaaaattttttaagtccataaactttctccttcaaacaccgaagacctggaacttagctgggcgtggtggctcacacctgtaatcccagcaccttgggaggctgaggcatgcggatcacttgaggtcaggagtttgagaccagcctgaccaagatggtgaagtgccatctctactaaaaatacaaaaaattagccaggcatggtgccgtgcacctgtaatctcagctactcgagaggctgaggcaggagattctcttgaacccgggaggcagtggttgcagtgacctgagatcgcgccactgcactccagcctgggcaacagagcgagactccatctcgaaataaatcaataaataaaaactcctggaacttaataagcaattacagcaaggttgcagaatacaaagttaatatgcaaaagtcaattccttttctataaaccagcaattaacaattggaattggaaatataaaacacagtatcatttacattagctgctccccaaaactgaaatatacaggtataaatataacaaaatatatacaggatctatatgagaaactctaccaaactttgacaaaggaaagcaaatatctaaacaaatggagagatatttcatgttcatgtatagaaacactcaatatttttaagacctcaattcttcccaatatggtttataaagccaatgtaattccaacaaaaataccagcaaattgtttcatgggtatcaacaaattcattctgaagtctatatgaaaacgcagaaaacccaaaataatcaacaaaatactaaagaagaacaaagttggaagacagataatacaagatttcaagacaagaccacaaggtactgttgaaagaatagacaaatagatcaatggaacagaatacagtatccatataaatatatccacacaaatgtagtcaactgatctttagtaaagaagcaaagaaaattcagtgaagaaagaatattctttttcaaaaaatgataatggaacagaccttacacctttcacaaaaaaataactcaaaatgaatcacagacctaaatgtaaaacacaaaaactctcaaacttctagaagataactgtattggtgcccaagagctgctataacatggtaccacaaactaggtggcttaaaagaagggaaaacaaatctggaaattagaagccttaaatcaaggtgtcagcagggctgcactctatctgaaggctctaggggagtatacttccttgtctcttcctgtcttttggtggttgccagaaatccctggacagcacgattcaactgtctcacacaatttaaaccacaacagtcttctctccaatcccccaaaagtcatatccttactgtatgcaaaacacattcaccccatttcaacatctccaggacccttgacccattccagcatcaactctaagtcaaaattgcctctaaatatcaactgtaatgtcccaaatctcatctcctaaatcatctaaatcaagtatgtgtgagatcctgggtatggtccagcctggggcaaagtttctctcctatggacactgaaatccacaaaacaagttatctgcttccaaaatacaacaggcataggacagacagtcaccttccaaaagggagaaactggaaggaaaaagtgggtcacaggtctcaaacaagtccaaaacatggcagggaaattttcattaggtttccagggcctgagagggctgtctggatccatgagtcacacaggtaatcttttcagtgaatggttgttcagccacacccttggtcctgtttcgggagtatgtttcctggattggctgagaactttcaaacccatcaagtgctggttcctttgcttaacaattccttcctcaagttatctctttccttttgcatttcactataagcagcaaggaaaaaccatggccccatctttcacgctttacttagaaatctcctcagctcactgcctacaagttctgctttccacccacaggtaaaacacagttcacccaaatttctgccactctgtaataaggatcacttttcctccagtgtctgataatatattcaccacttcctttctaaggcctcacaagaagcacctttaaagttcacatttctagtaacattctgttcatgacaacatatgtattctctaagatgcaaagaatctatgatagatgctttttctaaaattcccctctctactgagccttcaccagaatcacctttaatatctgtatttctacaaatagtcttttcaaagcagtctaggctttttatgttatgcacctaaaaattattccagtctatacacaattccaaagccacttacatgttttttaggtagttattccaacagaaaaagatttccgggtatcaaaatatgtattcatttcctatggctgccataacaaagtgccacaaattggatggcttaaaaatgcagaaatgtattctctcacagttctgggggcagaagtctgagggtggcagcaaggccatgccctctgttaggccccagggaaggatgtttaattgtctcttcctaacttttggtggtttcagtaatccttgatgttccctggttatagacatcccactccaatttcagcctctgctgttacatgaatttctccctctgtgtccaaatttcccttgttttacagggacaccagtcattgcattaggacctcagcttaacttgtttaacatttgcaaagatcctatttctaagtaaggttggactcacaggtatctggggttaggacttcaaaatattctcttggggtataaaattcaaccacacaacaataataaaagagaaaatctatgtgaccttggttttggcaatgagattttaaatacaacaccaaaaggataatccaggaaacaaagttgataagctggactttattaaaattaaaaacttcttttctgcaaaatacactgttaagagactacaaagacaagctacagaccaggagaaaatgtttgagaaagcacatatctgacagaaaatttctaataaaaaataaacaaagaactcttaaagctcaacaatgagaaaacaaacaacctcatttaaaaattggcaaaataggcatgccactgcaaattccgtgaaacaggagaaaaactgtgagttcccaaagtgtaagagggagaaaaccgacctccaaacacacatccctgctgggaatctgaaaatccagatcacaggagaagaatttaaccttacctagagatggaagggatttagagagtcacacaaaatatgaaagtagaagtagcagcaggaagtgccttgtatgcactcccagtctccagctcgagcatagggacgccatccctgactatatctcactggggcccttgtggaagacaaccagcagaactgcggaagtgttgtggggtgaagaaagctcccagatgaaattggtagtggtttcgactgggcacacattttctggagtggagtccgaggaaggagcaggagctgctgcagatacaagcaagtacaggagtacaagaactgccaccaacagagcaggggcaaggtctgggcggggcattgcaggatatgcgggcttgccaactgcatgggagttgagtcaggcctcttgctactggctatccctgacttccctggcaaactatataatacagtagaggcggccaagatcccctatggaacataaccccattggccggagaaccaacccccagcccccacagtggcctcagcaagccccgcccaaggagcttgcctaaccctgctgcctaaccagacctgcctaaccctgctgccacctgacggcatttccctacctgccctggtagcctaacacaaaacatagaaactctggggagcttcatcccctgaaccctgcccccagcaccctctgctctggagggttgtctttaattgtctatggagcatatatatatatactctttccctatggtatataagccctgagtctggggagtaatggtgtgaacatctacctgtcttacacgaacacatttctgcccaagaacacatttctgtccataagtttcccctaaaaatcaccctctgccaataaactagatatgcctgcctcattctttgatttcttggctccttctgtatttggaggttattttgcatatatggccctttcaaggaatatctatctatataaagataaaacaataagctatcaagctataataagatatggagaaagcttaaatcaatgtttctaaagaaaagaagccaatttgaaaggctgcatactatataattccaactatatgacactaggaaaagcaaaacttttgagacagcaaaaagatcagtggtaagcaggggttcaggggttgagctagaataatgaacagaagaagcacagaagacttttagggcaatgaaactattttatatgatactataattgtggatacatgacattatacatttgtcaaaacccatagaaatgtacaatataactagtgaaccttaatgtaaactacagacttcagttaatactaatctatagatattggcttattaactatagcaaatgtaccaaacaaacacaacatattaataacagggaaaaccatggggctgagggggtatagggtaactttctgtactatctactcaattttttaataaatctaaaactgttctaaaagtagtctgtaaaataagatttttaagagcaaacagaacaagaattttaaaagataattgtctgaagcacaaataatgacaattatatggtgcactttataagatatgtagatgtaaaatgtatggcaatcataacacaaagtatgggtgggaaataatggaagcacactgttgtaaggtatatatattatactatatgtgaaatgatatattatttgaaggtagactgtgacaaacttatacagcctagagtaaccactaagaaaagaataaaaagaaggagaagaagcatggaggagaaaaagcagaagcaacataagggcagagtggagataaaatggagtaaaaaattgagtcattaaagaaagcctcatttaagccaaaagggtatgggaaaagaagggactagattaaagaacaggtaaggcaagtgcaaacctggcaagatgatagattaagatctaatcatatcaataattatattaaatgtaaatggtctggccatccaaattaaaagtcagggattgtctgactggattaaaaaagtgagatccaattatatactgtctacaaggaacccaccgtacatataaagacattgataaactaaaaaaatggaaaaaagataacccatgtaaacactaatcaaaagaaggtagaatggccatattaacatcgacaacatagactttaaaaaatgataaacatttccagaaatgaaaaggggcattacataatacataggaattctaaatgtgtgtgtatccaacaacatagcttccaaagtgataaaatgaaaactgaaatgaaaaaaacagaaaaatctacaacaatgttggagacaagtaggcagataataaggacacagaaaacctgaataacattatgaagcaatttggcctaacttttatagggcatcccagccaacaacaaaataagtattaaagtggacacggaacattcacaaggatagtccatattctgggcctaaaaacaaaccataaaacattaaactgaaatacaaaatatgtttttaaaaatggaattaaaatagaaatcaacagaaataaatctttaaaattctcaaatatttggaaattaaacaatatatttctaaataactcccaattcaaagaagtgacaaaggaaattatacaatattctgaattgaatgaaggtaaaaatacaacatcaaaattagtggatgcagctaaaacagtgctgatagagaaatttatagcattaaatatttatattgggaaataatagaggccttaaatgagtaatctaagttcttaccttaagaaattaaaaaagaaattaaatccaaggcaagcaaaaagagggaaataataaagaggaaaaaaaatcaatgaaatggaaaataaaaaaataacagagaaaaatcaatgaaacccaaaacaggtccatgaaaagattttaaaaaaaattgctaacctctagaccctcaatgtccagtagaactttgtataatgatgaaaacattctatatagcagcaccctccaatgtggaagccacttgggactactgatcacttaaaatgtggccagtgtgactgaggaactcaatttttaatgtaattttattgaaattaatttacatttaaatagacacatgtgactagggataactattgaacagtgcagctctagaattgactactgaaagaaaggaaggggtgggaaggaaagaggaagaggaagagataaaggagggagagaaagagggaggcagagaagatgagatacacaaataaccaaaatcggaaatgaaatgaaaaagaggacttcactacagatcctaatgttagtgccattaaaaggataataagaaagtattacaaacaactgtatgccaaagttgataacatagatgaaaaaaactaattccttgaaagacacaaagtactaaagttcactcaaaaagaactgagtagcatatacaatctgaatagccatatatagttttaaaaacttgagtccatggtataaaactaacacaaggaaactctaggcccagatacctccctgttgacctctaccaaacctttaaggacgaataacaatcctatacaaaatgttccagaaaatagaaaagagaacactccaaactaatttatgagaccaccattaaccttgataccaaaatcaagaatattacagaccaatatctttatacaccaatatccctcatgaatgtatatgcaaaaaaaaccttaacaaaatattatcaagtagaatagatttatttctccatttatttggttttctctcttcaatgttttagagtttttagtattcaaatattacagaacatcattagatttatccctcagtttttcatgtttttgataccattgtaaactgtatttctaagttttaatttccaattgttcattgccagtgctaaatacaattgatttttgtatattggcctcacatcctgtgtctttgccaaagtcatgttatttctagttgcttttttgtagattcctcgggctcctacataaacaatcatgttgtctgcaaataaagacaattttatttcttccttttttatctgtgtacatttatatcttttccttcctttatttcactgactaggacctccctataacgaacagaaattgtgaatggaacatccaatgtgatgctggtataagaatagacatatacctcagcaggaaagaacagagagattagaaataattcacacatagcaacaattgatttaggaggggaaaggtgccaagataatataatggggataggatagtgctttcaacaagtgtgtgggaaaatgagacatccacatacagaattatgaacttcaccccatactcatattatgtacaaaaatccactcaaaatagatgacagacctaaatgcaaactctaaacctataaaacttctagcttaaagcttaggggaaagcttttgtgacactggattacacaaagatttcttaagacactaagcacaaaccacaaaagaaataattgataacttgactttgaaaaaatcaaaagcttctgctcttcagaagacagcattaagaaaatgcaaagtcaagtcccagtctgggagaagatatttgcaaaacacacatctgaggaaggacctatatcctaaatatatagacccttataactcaaaaagaggacgacccaattttaaatagtcaaaagatgtgaacagatacttcaccaaagaagaaacatagatggcaaataaatatatgaaaacatgattaagacaactggtcaacataaaaatgcaaaggaaaaccatacgaaatactgctacatacctactagaaatgctaaaatcaagcacacacacacagtccaatacaaagtgattctggtgaggatgtggagcaaatggaatctcatgcattgctgctgggatctctactcatcatcttgctttatttttcccaaaaccactttttattaccttaaagtttgcttacccatgtaagtccatatatatcttctcacatgtttattgtctatcttccccaatataagtactatgaggctggcaacttggtctgtcctgtcatcactgtgtcattctggcaccaagaacagtgtctggcaatctttacatatttattaaaagtgaggaaggggtggaaagaaaagacactaagacatctataagtgaatatatgaaggcaaggaacccagtcacagccatctacagaggagcgttaagagaaaattaatttagaccaccaggaagctgcatgttgtaatgcatgattcccaatttcagctgcacattagaattagctggagagctttgcaaaatcccaattccaggccacaccagaccaacaaaatctgaatctctgagaatggaacaccagcactggtcatttttttttttttttttttttttttagacggagtcttgctctgttgccacgctggagtgcagtggtgccatcttggctcactacaacccccacctcccagattccagtgattctcctgcctcagcctcccaagtaactggaactacaggtgcatgccaccacgcccagctaatttttgtatttttagtagaaatggggcttcaccatgctggccaggatggtcttgatctcttgacttcgtgatccgcccgcctcagcctcccaaagtgctgggattacaggcgtaagccaccacacccagccaagcactggtaattttaaagttcccaggtgatcccagtgtgcactcaaagttgagaatcactgaaaaaatggaacctagaccttggaaatgtacacaactgagtgtgcaagctacttaacctcccttagcctcaaaattctcatctacaacatgggaaatatatgtacctcccagagttgctgaaatattgagattctatataaggctctcaggaaatgtaaattctcatccccaagggaaacttgatcaaatcttcatagcttagggtaagaaatgctaattctaccagcaattcacatttttcattgttagctgattattttattgaacatttacattgaggaaattcagaaatgctcatttttccactttcctggtggtaagatgctgcctgaagctatgtttaaattttcaagagtaaataaactatggcgggaaatctagctgactatgccagtgaatctcaaacctagctgtacattagaatcatctcagaaatttttttaaagaaacacacgtacgtccagaactcaccaggccaaattaaatcagaatccctggggtggctccagaatatcagtatttttttaaaaagctgatagaaaggtaattgtaaaacacagtcagggcttaaaagcactgatttgtactaacgatatgccatgctaactgcacatcacagtcacttggggagctcttaaaaaagttgattgattccagaaccctaccgagacttactgattcagaatctgtggaagtggagcctgtcattgtgcaaatcttcataaaactccccactggtgattctgatgcaaactcactgagaaccactactttgtatcatacatttactctacgtgttgtatatcagaaagatcatttaaaactttcagtggtctcaaatgccaagcctgccagttacttttaatcagtaactgacacaacacatcacagtaactccaatgactttacagatcttttcagaacacttttatgtccagcccactgacccacatcacctaccctatgctgtgccaaatactggctatgtagtccgttggtatttctaaccaaattcctctaaatgggctgctgatctgggaaaagcaacatggaatcacattactccccaagccttattcccctttgctaagtggtatgtaatgccaggattaatgaaatgaactctattggtcaaatgagtctgaatgaaatctgagttgttgtctgctcctggaagcaaactgttatctatttgtttccctcagagagataaactcagaggaaacaggagtgatccctgaggtgggaataatatagtgggctgcaattttaaaactctgcttagacaataacaggacacttggaatcttattttgatagatcaaaccaatcagtatatacagcaccatggtggtactaccaggcaggtgataatagtagcatttaaacaaccaggcactatattaggcatattaaatatattaactcatgtgattctcaactgcgatgataatagccctatcaggcaggtactattattatttccattttgtcaaaaaagaaacaaaggcacacagaagttagatgatttacccaaagtcccatagctactaagtggcagttttctgaaaccaggcaatctggctttggagtccaacatcttaagtactccactgcaatgcagatgagtgatggccaagcagtttaaaaaaaaagaaaaagttattgtctgcagtagaaactggaggtcagggtatgggtaccttgggcaaattacttaacctcttggagcctatttttgcatctgaaaaatcaggataataattgtacctgccttgtagagctgaggtgatgattaaacaagattaggcatgtgatgtgcttagaaaagtacttggcacttttaagagctttctgtcagccattattattatttgtattttaaaacagctcaagtggtcagggagaaatgaaaatctattaaactgaaaattttcctgccaatcttagatttgtagattctgtagattaccagtacatcagatccaatatgaaatgcagtcataaaagattttcacaaaaacttaaggactgtcactgtgacaaaccccagcccaaacagtccaggacaatggctctaaaaagcaaacatcttcaattatcaagctgtgtacatgtaaacacaacaggaaccagacttctgagtagctgcaaactgcagttctctgtgatgggagaacatgccccagaacagcctgtcaagtggtaattgccagccatcctcagtcacatatgtataaacagaaaagaaaaacaaaacgagggctcaaataaaaagcgttaacattcattaaacgcctgacactctattaaatgtttttcatgcattaccttctttaatcctcacaacacccttccaaagttgaacatgaaacaaccacactggtttatatcactttaaatgtaagactacacgtctcaaatgggccctgagcactgcctgggaatccaactctatttctctagtacgctcactttcaccctctctaggactctgtcacatatctctcctccaagttcccacacctttcctctcccccgctgccctccctctaagctgatggatgcctataccaatagactcttttcccaccacccactgtatctgcacctgttatctcagcttcccctctagttacaacagagtaagtgtccctgctcatttcaaaaccaactactcacctgcttagggtcttctcctttctcaggtattcaacaactaccctttacaatgttcccctctttcatctgcagcagtttttcctttctacgagtttaatcacattgccatataaacattctgctttcttctatcttgaaaaaaactctacccaaccttaaggcccctcttccccattaaagttgttcttgtcaaaatgattaaaatcctcctaattaccaaaggcatcttatacggtaacattcaacatggttgaccactacctccctcccttttttggcttcgcctcctcttctttgtgtacactattaaactagatgtcttcaccagtcccatatattttaaatactatgtacagtatatgatgccgattccaaaggttaactctagcccgacatcctccagaacttcagatttaaatttctaaaaagcacatttgatatctcaacccaaatatctactagataatttatgtgtgtatatttcaccatactaaaaaaaactaccaggtgactgataaatggagagaaggtgaataggtaatgtgaaaaatcaaatgtgctaaatattcatggcacctgtaggtggtaggtggtcagagtcctctgcaaaattcttcccagctatgcttatgtcttctattgggaaaaacctactgggcatctcaaacctaacacattcaaaacataagtactgattccacaacttccaaaaatgaaacctaccccatcctacagttttccttgagtcaaggctagcatatgagggccttggcatatgggggcattgcctatcgcgttcatagatattctgagcttctagaacagcatctggcacacaggaggcgttcaaaatagctgctgaatggattgatgaattcatgttctttctttctaggtccctcgacctccacccgcccttgagtcattgggaagttctgggctgtctcagcgcctgatgatggcttcttaccaatcataccacacggctgctcctcagggagttggtggcattcccctaccacagagccacagggttcctgtcccggtcccgtctcgcataggcgccccaacacgcgtcacagtgcagctggcatcacacggccagaatcacgtcctgccctctggctgcagcgacactacttcacagctcaggcccacccgggcagtctcccgggccagggccacaacccacgccttgtgacccctgcacgtcaacggcatcttccttcttcacgcccgccctcccacagcccggcgcagcggcctcccgcacgccccctgcccacctggcccccagccacctttcctcacctgggcctgcggggccgccccaactgtcccgctgcaaccccagcagcctcgccagttgggtccacgcctagcctgccggccttcgtcgctatccaatcccacctgcgcccgcgagcctgcgcactggagctttgccctgcgccgcggcactctgccctgcgccgcggccctctgcttgccaggccgggagagacagaacctgcctctaccggtcttccaaggcactgagagcccatcgccgcggacgccgctgtaaattccctgcgggccctgtgcaccaccctgtgcgcgtccccctctcccaggccaggctgataatgttaacagctctctgagctatgctcatatcctgaaccactgaggactgtgttctccaggaatgctcgcctgacccacgcctgccctctaagcccctaatgaggccccagagggctggggtgggggggtctctttgtagtatcagagcagggcagataggcaaaaggagtcagagcctgtgccagaatatgaggtcagttggctgctaggtcaattaagacaacttcagcaagggtggtcaatgtagagggaattcaatcgttggcattgcctgaaaacaggaagccagaatctttttatcttgacgaacaaacctctattcattggtcctgacctgagccactttggtgaatccagataccctgaaggtgtgacaagacctgcctcacttatcccccagccttcagtgctggtcccacagagagccatatgcttgagctgaactgcagttaagcagtgacagctaccctctgtccaggctctgaggccagctttctgctccgtgagtcactgacagtgagtctctacagagactttttctttctgtagcagccaaggtaccctgcaagcaacccacgccattgccatatgtcttagtttgtttgtgttgctataaagcaatacctgaggctgggtaatttataaagaaaagaggtttgttagtttcacagtttcacaggctgtaaaagaaacatggcaccaccacccgcttttgatgagggcctcaggaagcttccactcatggcagaagacaaaggagagccaatgtgtgcaagacagaggaagagagagaggtgggaggtgccaggctcttttccatgaccagttctcatgaaaacaaagactaagaactcactcagttccatgagactagcaccaagtcattcataaaggatctacccacatgacccagacacttcccaccaggccccacctccaacattggggatcaaatttcaacactagattttatttatttatttatttattttgagatggagtctcgctctgtcgcccaggctggagtgcagtggcgtgatctcagctcactgtaatctccacctccccagttcaagtgattctcctgcctcagcctccccagtagctgggactacaggagcatgccaccatgcctggctaatttttgtatttttagtagagacgaggtttcactgtgttggccaggctggtcttgaacacctgacctcaggtgatccgcccgcctcagcctcccaaagtgctgggattacaggcatgagccaacgcacccagcccaacattagatttagatgggacaaatatccaaactatatcaccagggtaagattcccctttaaagatggaccccatgtctaatgtttcttcatagtgcctaacatcaagattctgcactggtcatcatttcacaaacatgagcagcatggctgctccaagacacacagagggaataacccccattcacatcaccaggaaatccttgcatggaggctaaatgaacagttggtaagagtggaccctgaggtgtcattccatctcccccagacttcctgcttgaccacacaatattcccagaagccagtgacccagaaggctcttcttggctttctgtccttttacctgtgaaaaattcgaagaactataaagtttagggcccatcacagtttactacccttctttggaggcctctttaaacccttgagtcttaccaattaccagtagcactaggagctttgcaagcctggccttaagtccctgctttgctactgaatagttggtgacctttggcaggttacttcccaacttgtgtctcagttttcctttttttaaaaaaggagacacagttgcaagtgtttaatgacacaaaaaacagaagcattcatcaccacgcctggcagtgaacactgcttttcttgctcaagaggtttgagccatacgcttctctaggtctgtgactctcccagagtttctgggagttcctctgtgagcaacagacccactgcagtctccatactttaggggtaagcctggatgcccttcacacatcagtctggatgagttcatgcaccactcatccaaaagtgaatccaaaagtgattccaaaagcagaggccagagatctagttgctaatgttgcctctcctcatggttctaggattcagccacacagggcttcccattgcagcttcaggtcctcctcactccccagtgcaggcccagtttcactctcaggtcctccagcccaggcctcagttctgcctcttttagtccatccctccagatccactttccaacagggctgggaagtcgcttggttgtcccctgcctgctgcaccacagcccccagacaccgcctccttatttcctgcatggtccgaggctcaatgctaatccctgggtgtcttagtctgttttgtgctgctataacagaattcctgagcctggataatttgtaaagaacaaaacatttttttctcacagttctggagaatgggaagtccaagatcaggtgccagcatctggtgtgagtcttcttgctgcatcctccagaggagaggaacattgtgtcctcatgtggcagaaggcagagagcaaataggaaaaaggaaggcaaactcaccctcttctaatagcattaatctcacccagaaggacagagtcctcatggtcctttcacctcccgaaggtcccacctcctaacactgccacagcagcaaccaaatttctttgaatattaatacatgagtgtgggaggggacaaacattcaaatcatcacactgggaaggctcagctggaggagcagaattggccagcacagggaggtaatgctgggtttggaatttttgtctttgcagtccttggccttgatccggatacccagacgccctctgagatggaccttgagggccgtgccaatgtctgctctctgctgaggtagggctcatctactccttacaagtataagaacttactgccaaacataccctcctccaagccatgggtccccagatacagtcaggaggaccccagtggatagctggaactcaggacctcaggagagatcccaaggcctatgctcgagttcagagttttctaattcaggcttggagcccaggaacagaagataattaagaacaatactgacagaaaaaaataatcacttcattgacattacccttcacaggaccgcctgcttcaggcctgtgctttgcagcctggttcatttgggaatggtatgcttcacacccagccctgttaagtgtgagttgatgaggaccatgagcttggaagaagccgtgggggcctctctgtgtgtttctctctgccctgctttgagacacttcacataaaagactctataaaaataaactgtggagatttcaatgccagtaaaaatcccagtggaggtagaaaactatttaaagagcacaaggacatacatttatcttgttgtgaatccccggctgcctggtccctgagcctgacacacggcagatgcccaataaatattaatagattgatcaatttgttggctgctcatccatttgcagcttcagccagcccatggctctgcgtgcacacaccacaaggagagagaatccatagacttcgacaggagagagctgctcagctggcaggagagcctgccacaaacccttgaacataaatgtcctgccctccacttccagctctacgtactaactgtaaaataatgatgtggcagaaagtgaagtgcaaagactgccaaattctaagaaagaacctggtttcatgccttttaatccttatgagtcattccttggtctgcgccaagccctgtgctttacagcaagaatacagatgtcttcattgaactgcatctcattagctggacctaacagagtgcaaatttctttccaatgccatttgaactcaatgcccagatgcttttttcccctgggcccgtgcagatgaaatcttgggctggtttataactttgaacacccagaatattcccatttcagtttaagattccctctgacttatctaattgttaggctctcttcaccttcagcctgagaaatgggtaccatcaatttctcctttctcacccagcttcacacccaggccctccagactcagtgggtgtctgacacctctacagctggagtccttcagcaatgggccccctgggctcagcagatattttgagctggccatttcttctgtgagacaatcttgtgttttctcaggaattcccctgcagaagatctctgagtacaaacccatgcccagtgatgttgcctctgcccagctacttacaagaccattcctcggcccatccagggctaccaatctgtttatgtaatttgtgccatgaataaaggtaccagacaaatgagtaagtggaggctgagttgtaggcatggttttgtgccccaataatgggctgcacaggaaaggaagggccacctttgtgtaattcataagctacaggtggatgcctttttgtgattccccctaatgcatgctctgtgtgagctgaggctctggctctctctctgctggggtcaacatcacccctgcttgttttacaggctatgacctgcctgcagcttacttgcctacataaaaagggcatccgcgcccttgccctgacacagggattggcggttcactcctagcgccatcctctttctctttgctctcccgccagacatgttgttgccgtcatcacctctcaccatgagattgctcagggatgttccagacaccaagccctttcagaagacacatgtcaaaccctgtatatgatttgagcagtctttctcatgtggctggagggaaaggagaggtacctcattcctctcccctccacaaggaggggaaagaggtatggaaggggaaatgtcatagcattccaacaactcttttcagaggaattttctactcctggcctcaattttttataaaccctcatgggtgtgttagtggtggaagttatctaggttatcggtggcaaacctgtatgggtctgcagcaatctcaactcttgcctcctcagaagaaagaatctgaggtgcataaggcagaaggagaggccaagacaagtgttagagcaggagtgaaagttcattaaaaggctttagagcaggaacaaaaggaaagaaagtacacttggaagaggcccaggtgggcaacttgaaggacaagtgccccatttgaccttgaacctaggatttcatatgctgaccgacttccagcattttgcaccccatttcccttgatttttctctcagggtgagctacccacatgcacagtggcctactagcacctgggaggtgagcatgggcagtgtgtttagtggagctgtacgcatgttcacctgaggctttcttccctttcctggtggaatgcctctggaaggtcatactctgccattttgcccgttaatgtgcatgcttgagcccacttgcccaattcctgaaagctgccagttacagatgtttttatctattgggaagctgcctctctctggtgctggctgtgaccaattattctttcagagaggcaatgtgacaattgcctgaccatcacctgttggttgcctgacatttcttgttggtgggggtagccctctcctgctctgctcctgcctgactagctacctaccaggaactccaaatgactgcaagagagagtttggagatggtccaagagctgggattggaattggagaactaggttatagccagatactggagagtttcacatgccatgctaagaaatttgaactttatcccataggattgcaggtgaacgatattcagcaggagagtacctggtcttatttgcctctgagcatgctgggtggagaggcatgatgaaagtggagacctctttggtgtgcactaagtaggttaataagcaatgttcagagaatcttccattcaaagtaaaaaaatttctcacctttttttctcatttctcaaggtggtttctaattcggtcttgagagccagacattcttcctggtttgggttttgtattcttttatgagttcatcaatcaggtgaggccacaaggggagacttagtgctcaggaacacaaaatctattatactcttgggtcctagagacagcaggcacagcaggccacacaggaccacatggggaagacaccagggtggccaggagactgaggacaggagcatgcatttgatatacaaactaaccagcacagagctacatctctatctggccctacgctccagagaccatattcctctccttaatcatcccagggccaggtacaagacaactagaaaccgtgcctagagccaaagcccgctggaatgattcaaactagctagtcctaagctgttcaccctgccttgccttgcctttcccatggaaacccggtaaaagctatggcctaggtggccccctcacctgtcttctgcctcctgaccaccctgatgtctttcccatgtggagtggcatggaatgcctcctgtttctaggacctgtgtgtatcataaactttattttcctgagcctgtcctgggtctcttcttgtggccacacctgactgaccacatcataaaagaatacaaaacagcttgccaggtccttaggtgggcagcatgattgagtgagaagggcataggcctgggttttatttcagtgcctttatctacttgtggcctcagacaaattattgaacttctctgggtctcaatttcctcatctataaaaatgacccttgcagtgtacgagtcagaataaactagattatgctgctgtaatagataaaccctgaatcttagccacctgtatcagtaaaggtttccttcttgctctcagtgcatatgcagtgagggtcagctggccactctgctccctgctccctgacttagcacacaggctgatggcacgcccactgtctgtgatcacattaggatcttggtgacagatggaaggagcactctggtgggtcgtccacctgcaattaaatacaccggcatggaattggcaatccatgcctctcctcacagctccgtggttggaaatcacatggccctgctccaccacaaaggggccctgtgtgactaccacagatgcctactccacaggtgtagggtgagggttacatgggctacaacacaaagagcctggtgcagggcttgaaggctggcaggttctgacaaaactcttctaggaagagcagcctccacccacagctgtggtcaagactaccagattcgcactggcaagtactttagaaaaagcatactgtctacagtaacactgctaagcatggagacttatttatttatttttgagacagagttttgctcttgttgctcaggctggagtgcaatggtgtgatctcagctcactgcaacctctgcctcccgggttcaagcgattctcccgcctcagcctcccgagtagctggaattacaggtgcccaccatcatgtctggcttaatttttgtatttttagtagagatggggtttcaccatgttggccaggctgctctcgaactcctgacctcaggtgatccacccaccttggcctcccaaagtgctgggattgcaggcatgagccaccatgcctggccagagcttttcactttaaaattatttcaaaatggtaaaaggaaatctgaaaagtccagtgaaggaaaaccacttgggaaacagaaatcccaaagatcaggattgataaatgtctctatcttcgagttatagacagagagggctccaaggacaaaatttgaggaaagatggttgataatctcttgtgtaagaaagttttcatttgcaagaaacaggcagagcaacttaagctggcttaagcatgcatagactgattgccacaggagctccaagtcccgctgcatgacagggttcagttggttgattcagttataacaactgggaccccagctctcaccattcttcctgctctggcatccagagtgttgatttcgcttggcttcctttgaagacagatcccttttaaggtcatggaaaggctgtcagaagctatacagtggggtagataaataattgcttctggaaattttccctaaagatgtgtgggcacttttctaaaagtccctatgaaatatttgtgtgtttcactggcttaaatttaactatgacttctgtccctagcaagaagggttgccttaaagccaattgggccttcccttctcccccacctctccttaacttcttgtaaccactaatccattctccatttccataattttgtcattttaagaatgttctataaattgaatcatacttgtactacctttggggattggcattttctcattccacataactctctggagtttcatagaagttgttgtgagtatcaatagttatttcttttgatatggattaccacatgttacttagccattcacttatttgaaggatatctgggttctttctcatttggggtcattacaagttaagttgctatgaatattttcgtaaaggtttttgtataaacacaaatcttaatttctctaggataaatacccaaggtgcaattgctgggtcttatggtgatcgtgtgtttagtttcgtaagacccaatcaaaccattttccacaatgtatacactattttacattcccatgagcaatgtatgagcaatcccctttctccatgtcctcagcagcattaggtgttgtccttattttttatttgaccatcctgatacatatgtggagatatcttattgtagtttagtttgcatttccccagtggctaattgaagttgagcatcttttcatgtgcttatttgccatctgtatattatcttcagtgaaatatccattcatgtatttttcttattttctaatgggatttttttcttttgtcaaggttgagttttgtgagttctttatgtattctaaatactagtcctttgttccggatacttcctcctcatttgttgcttggatcttttatcctcttaacagagactttttacagagaaaaagaataaacaaaaaacaatttgtcaagttttccttttctttttacagatcatgcttttggtgtcaagtctgagaactctttgcctagccttagatcccaatgattttcttcccctttttttccctaaaaatcatatagttttgcattgacatgtaagtccaggatccatatggagttcatttttgtacaaggtgtgaggtttaatgtcaatgatctttttttttttttttcatctacggatgtcctattgttccagcaccatttattgaaaaagcaattctttcctcattgaatttctcctgcattttgtcaaatatcagttgggaatatttgtgtgggtctatttctggattatctattctgttccattgatctatgtgtccatctttctgtctcactattactgtagctatatagtaagccttaatattaattacagtgattcctcccactccactctactttttgaagattatagctattctagtgcttgtgcattttcaaataagtttcagaagatatttttatttgtataatgtaaattacattatgaatatacaataaaatttataaaattaatttcagaacaaactcatctatgattacaaaataccttgctaggattttggtaagaattgcattggacctataaaattaatttggggagaattgatgcttttactatgttgagtttggaagcccacttttgcactacaatttagtgctgaatatgtatatgctttagcaacctcataacaacggtgtgctggcacataataggagcttcataaatatttatggcagggaggaaggatgggaaggccaagtgaagtcttgaagagtttggatcagttgtccttaaatctggccacagaaacaaccatctgctgagcttggtaaaagtacagatttctgggcttcatctcagccctactgattcagaatctccgggatgaggccagtgaatctgtattttgaacacctgctatagttgatcctcaagcacagccaggtttgtagcatgtagcagccaacaatggaagcagtgtgcaggcgctgagctgagtctcctaggaattagctgttctttctgacatttgccctgaaacaaagcaagtggtagctgcaattgagtccacctaagacaaattaacatgttcttcctgatatatggctcaaaatgagtatagcagcctgggagtcaagggtggtcctttcctacaaggaggaggaccagatgtattttgagcctgtatccaccaatttcttttccaaagaggaaataagcaaccaatgttcagcagaatgtgagcagttcctaaattgtaaatactgttatttaatcacttcattgcatacttgattagttccctaaccttgaggcctgtgaaactgtaatgatgcaccaggggagctggcctcagctctgagagaatttagaacaaggctgttcagatccctggaaacatctttttcattaatagcagaagaagccaaatgacccataagatttttctgtcataaggagaacagaaaaattagaaacaaaagcacatagaggagagttcatgaattagattttagagcacagacttttttaatcttagtctttgtttttgtttggttggttattgttgctttccttctcttattttgcagtttcagtctctttattttcaatgtaaaatttattatataagtaatagatatataaaggtaatttttaacaaaataaagtgtattctcctaatcccatcacccaaactttggtcaatttctgttccattgctgagcctcccctctgttcacggtgcttctccttgtgcctgcgaggcattccatagttgtaaccagcatgtaattctgagttattatatcaaacactttactaagttgcgagttcttcgtagttatattactttcttggcagtgcagtattctattatgctattgtaccatcattttctctaatgttatcattattctaatgcatttcagccaattccaatttgttgtttttatcaagagcactacagtgaacatttttaaataaattgatttttttcttattctggattatttctgtgggataattctcagggatttcattgttgggtcagtgggtatacccatttttatagcttttgatatttctgaatatgccagcttcagcaaaattttgccagcattggacagtttttttaaattttatgaatgtaatgaatgcaaatcagtatattgacattgttttggttagaatattttgtgtgtttgttggccatttgtattttatcgtatattttgtctatggaaatcctgtattgatctattataaattaaaatgggctttctaaatattaaaaatattaatctttgttcacaattatgtaaatgctttcccaacccattgctattctttttacatgagttttgtcattattattgtatggaagtttaaactttttcaatattgtcagctttgtaggttttctgttgttatacttttggtctactgcagtaagctggaagagtgatcattcctctgcagatctgataaaacgagagcctgtttcctaccagtctttctctgatgtgtgtgtgtgtgtgtgtgtgtgtgtgtgtgtgtgttttatgtgattctagtagatgaagtgggctttgaaactgaatcatttttccagctctcccagttgtatcaatgaagttgtctccccttcccctatgctgagaccccaactttgccctgctttctctgttacacagcaccagatatgctcctgggcctgcctgtggtcccccagtgtttcttttgtgcatttgctaatccatgtgtctttagttctttgtcctaatatggggtaatgctggatctaacacatcactctgctttctttactagatatccccatcttatttttccttcatatgctttgtagaatcaggtataaagtccaaaaggaaagtccttttaaaagaatgtatagctatgtggagttgtatagaaaagatacagaaagatatcaaaacatattacacccataaccttggagccaagccccttaacagagtccttccactgtgataaccataaaactcctttgttccaaggtgaactatgaagtgcaccctgcaacactgtatctgtcccggagagtgtgtgccagtgctgcagcaagacttcaccctgcctggggtatcttggaggaagagattggttctcaattcctttcacaaagggaagcccccacccccttctcaccacctccccttcccacacacacacacacacacacacacacacgcgcacaaagctttgctggacgtaaaccccagaactgaagagaggcaacagccatgattcaaaatgagtcttggaattgacaagcatgctcttcttgaagtgagctcttaacaactgggccaggcccttcatcccaggtcacctttgcaggagcctacaggtttctttcccagtggcagagctggtgggtacactctttggaccaaggtcacctgagggctcttctgtccaaaggacctccatgcagaaaccctcagtctctgcctcggaagacggctgttctctgtgtttatctaaaacaataagcagcttttaatgggtgacctcgtcattttgccagtagccttccctaaacagaacagttccgtcctcttcttaatcccactgagcaagggagttttccttagcctcataaaagagaaatattttgtgaaggaaaagtaggactcatgccactttatggaaagacctgtgttacacaaattcacatgaaagacacattctaggggaaatgtgaaaagccaccaaaagtagaagcagacagatgtagtgtgaatccacctgtcctacctgtatgagctcaggaaattaaatcttctaagcccccttaatttttttttttttttttttgagacagagtctcgctctttcacccaggccggagtgtagtggcactatcttggctcactgcaagctctgcctccttggttcatgccattctcctgcctcagcctcccaagtagctgggactacaggcacctaccaccacgcccagctactttttgtatttttagtagagatggggtttcaccatgttagccaggatggtctcgatctcctgacctcgtgatccaccctcctcagcctcccaaagtgctgggattacaggcgtgagccaccgcacccagccctaagccccctttaaaaacagaaataagaatatcactcaaaactgacataaggattaagttaaatcacatgtagaaactaccttaagacgcactatgactgtcttaatgtctaaaaggaccaaatgaaataattggtgattaggtttaaaggctacactgctctgtaggcaaagtcctctttataaatgagataatatatacagtggagggggttcagcttataggggttatagacactttggagaatttaaaggctgttaagacctgtatttcccaaaagaagcacacaagtcaacattctaggtgcaatagcccatagatgccatgaagaacacctgtgggctgctgcatggagccaaactaagaactcatgccttgggcactcatgttggcacacccatcctctgtctgcaggggagggtgagacctgttctcctttttgtgcaggatcagtgattctaacaggactcaccctgagcacagcccatgctacagtccatatatagatgagggcatggtagagcctggcacccttgccataggtgagtgcttctccccacccagacccataccacatgttagggcacaagtccaactgtctggtttctttgactacatggaaaaaacccaacaggattgaatgcattaaaaagcttatatcttctcactggagtaattctctcctttgtgattgatgataaaaatagctaatgttttttaagcgcttaccactacacacctggcgttgtcataaccgcatgaagtgggtttggttatctggcagtcagctgcatattgaatggtttaaaagtcatgtgctgcaggtctcccagccagtgagtggcagggccaggcttcaaatctgagctcccccaaccacaatgccacatcttctgcctttctcttcccggctggctcagacgcactgcagatctcagtggactggcccttgtggtccccaccaattgctcagccttcttctttctgtttcccagccctgcggagccagctccaagaagactgccccctgcatacaagctgcttcctgcttgcccacatttctgtgaatccataacgtacactcccaatgctgtaaagtgttgtacttccccataaatgaacatgcacagtcttcaaagcctctgaatcttccactctattaacttgttgcttcctatttcagataagaaccagcccttttgttatattttaatttcaaatatccactctccttatcagctggcccaccactgtcctctgaggctccagctcaatcatttgtggtggctgagcttccttatgtacagccaggaaaatggagctgggacacaataggaggaaagttaaggagtgggtttcaattatacttgaaacttctcaaactgttgtctcgttaagtttcagtggaccttgaaactgtgtttatgtgaaagtttttggaacattcagcatttttaaatatacactgtaagtactttaacagaatgttgagtggttacagacctgcccagaatttaacctcccttcctcccagtgtgacagtttctgttgcccttactttttctgtgtcctcatcaatatgttctgaccctgcctggtgaccaggtcagcttctggtggctccttgcattaacagtgagactttcctgatgctggtctatactcagccacagcagtccaacaagatgggccctatgacaggacaccaagactcttctctgcagtacatccagcagaggggcaggtaggagcaggcaaaacaggaatcagcactagacattcagacccccaaaagagagagacctgaggagagggatgcacactcctgtacataggaggcagaacagatgggtgctcgacaggtgggccgtggagtggggaaccgatcaggtttgaattctagttctgtcacttacttattggataaccttgggaaagccccaaatgtgtcatgtgtgaaatgggggtgatgacagtccccatgttgtaggtcgttgtcatggtgcaagggccatggtaagtgttctgtgaaaatggccattacaatgacgcatgacccccaaagaagatgcaggggaaactgggcaatgcccacagaccatcccccacccccagttgaagtggcttgatagcactgagccctgctctggtcagagctcagccccagttcacccagccagagtgacacccacctgagggcaccgtattccagggccacaggctcctccaggtcttcccattcactcccactctctggggactcttctggaggcaaagactctgggacagtgccccaagagcagaactgtggcaagggaatggtcccagaatctgcctccaaacattcttcacagggtagctggccttggcatgtagagttgatggtaagatactcttcatcctccgaggtgggagaaggggctccacatggatggtacatgtcaccttccccatcctccccatccaattcaggactagaatacagaagcccatgtttcttccagccttgataaaaaaaattcctcaccccaccttccccttgccttttagaatactctgcacgacacaggcccgtgagactcagccagtgttcaaacagctcatgccagaggctgctctgggcaccaggaagcaagaaacttataaggcaccaaccctggctttgaggagcccccaatttaatgagaagttggagcagtaaagaaatgttacagtccatgtaggaagtgctatggtagaggcagctggagcaccttaccgagctcaggagaccaggggggtgggggggcttgccagagggcacagcattgcaagcagggcaatgacccagttctaagacagactcgtcacatggcaagcagagtcggtcagactttggacaagtttattgacttctttggaacctcagttttctcatttgacaaaactagatggtcaagaagcatctaggattattgggacacgtaaattacataattctgacacagcccccccaactctgggttcctggtatggggtaagtttttagtaaatgtgagatgctgtgattagtactgtgaatatgatggctatttcaacagaagaattataaagaaagggcttcaggaagggattgggagtgactcaagcaggcaaccatcaaagcactttgtgcaaagatcaggtccttttctgagcactgaaaatttgcctatttagagatgcggcaagctgaagtgacatttactccccgcggaaggacacaggaggcagacaagtggtgaagctcattatctggtgatgcagccgcagacgtaatggtcaaagaacaagacttccaggggctgccccaagttcgccacacacgcctcttgattagaaagaatagtccatgcaaaggtagggcattttacacagcactgcagacatgcagagaaggtgctcagaaaatatctgtcgaaagtctggttagaggagatgagaaggaatatctaagagaaaagcacaaagatttagcaaatacatggatcctcatttctcagcctccttacccccacccaaatcaatgggttggctttgttatgtgctgctgctctccttctcctttcctgcattgcctctttctcttaaaattggctctggtgcaccccaatagctacaaacccttagatacccagagagcacgtcctcctccccagtagagccggaagcatctgtcccaaactgagcttcactgtgaaagagacattatttccactcatgagagctacaaggtatgtgaaatagtgaatttcatgtaaatatatgcacactcaagtgtataaaaaagaaattattctacaaagactgaagaggaacactcactgtcaaaagacatttttaattcttgagcatttgcagggaaaattgactttaagcttggctaaatcatgtagaaactgtgttttcttataaacatgggaaagaaacattcaagaagttttatcaaagaatgggaaatctagcctattgcccaggcctaggctcaccactgtccccaccacctcaagcagcacccccttccctcctttctgagctcactaagccttgttgaggagtggaagatggcagctgtatgtgtccattggccactgcagctgcctcagtgtccacacctcacctcccacccatagactccctccacctcttctaataagctccttgccctctggttttgattctgagctccagctactggctctgcctggacagagacctagagaagccatcagcctgagaggcaagaggcaaggcttcatctgaggttcaaccaaagaaaaagcgatttgctccccacttgtccagggggacttggtggtcccaagggtgaaatcgtggccatcatcccaccacaagttgggagaacgactgcctttccttctatccttttgcacgtgccatcaggctgcccttggagatttgacctggggctcaactgtggacatagggaaagggtgaatagggaataaagaggcaccagaagcctgtatgcctatttcacagaaagggcaagacttggaaatttggagaatttcattaagatagagacattctttcacagcaagcctcatgttttgcatgtggacatgatgggtaaagaggtggagttcttcacccagggttcaaggccggccagctcatggctaatgtagcaggactttcagcaagaccctgatgctgtcggagtacacggggctctctgctcaccccctgattctgtgtaatgatctcagcttcttcctgccctcactctctgcccaccaagctgtccaacagaaggaggcttttatagacagatgataactagaggagaatctggagatttcacttgggcttcctggccagccatgtctcccatacaaaccagcaggaccccagaaccagggtccccaccaagtcctgaaactcttcagtgggtatttttaagaggaatcccagttcagctctgaagtcagtgaaaccattctgaaggctctgcttgctacagaatgtttactgagaaaagacactgtgcccaacttttctggacagctgtcctttaaagacttgggccaccaaattcatctctgcctttcaggaggaaattcatagaagcagattgggcatttcaggcttgaaatatgaaggtattataattgtcctatttacttacggttaaactcacaacaaagtttggggtttgtgtcccttcatgtctccagttctccaacatcaggccccatactgatgtctccattagccctgatgacacagctgggagccccaggtctctgctcctgacaactgcatttagttttggcaggttggatttacagtatctctaagacatcaaagtaaacaagttcaacggactgccagatttgaagctcagatgataaatctgagctgaagtacaatacttaggatttgtcacagtagtgtggacagatacccctgggtatctggggatacccaaggatagccctgggagcctgtaaggtgtaaagagaatcctgctagaggcagcatccaggatctagcccaggctctgccgcctccctcactcccctcagccacactccaacccaagagcaggcatgacatctccctcacctggcaactgcatccctccctaactactctgacatcacacctggcctggcccctgcagttgagtgagatctctggcctcctaattatcttttgctattccaggcagtgcccttccccagaaggtatatcataactttaggttcatttccaggagtcctgcttcattttgctttcttaaataaatgaccatcaagatttataccatcactttcacaaagtgatgcttgtggaacttacgtgcattttacttacatgagtttaatgatatgtgctaggcaaaaagagaaagagaaagataaccttaaacattctgcaaagaccaactttccaaccgataagtgtaagccttgaagtgcacatgagtgggagaactaaatctttcatcctgtcaatctgtctctgtttctattgggccagcatttaaagacaaacattttgcatacagcatggcccataaatgcaagcctcctaacttcatctgaggctcgaccaaacaaaaagtgatttgctcccacaccaaggggcaaataacatcactccttccaaagtgatgtttcaagggtaatgagacttgatgtgattgttgccttctgcctacctttaggaactaaccttataaaaaacatgtctccagccaagctttccctctgataggcacgtaatccaactctccttcataaaaatgtactgtactgctttattacaagatatttttataaagatctactactagatggtaaaatctctagatatagagtgtgagaaaagagaacagggaaagaaagtgaaatcgaatcttgtccatgaacactttgggtttgctgtggtgctggcagccatctggctgtaggaaattgccacctggcagatggtaagttccggcaatttgctgggaatttcaattgaagggacctgttctttagctggaaatagctcaggaaagggaaggaaaacagacttgcattgagttcttaccgcatgccaggcactgtgacagcaccctgagcgtgctatttcttttgacctgcacagtaccctgtggaactgtcatggtccccatttacatttgggaagcctccagcttagggaaggcaacgctccaggcatactagtaagtggcaacgctgaaaccacataataggatacagaaatccatgctctttttgttgaagagtttaactcacagatgccagacacttaagaggcagtggcctgcgacagtcacctcagaactgagctgcaaacacttctaaggcttctgcagagtcacaatcccactttggaatcctgattcagaccctatccaggagctgggggaactgtgtccaggggtcgctgggcatgcgtccctcttttcttcctgtagggggcagccactatgtgtgcattaaatgcaaactgacgtcctattggaggagaggtggacttggtttgagttctttcagaggggaggaaaggttcctaagtgagggagggaaaacgaagtaaaaataaagccaggaaatgtgatgaggcagaaagcattcatcaacagaactaccacagggaggcaagagaaaaagggggtgcggttggccattgagagagccaggataccgagaacagtaaagctgcctgcccacagttcatccatgggtacatggaccatgtgggcccggcagtgagtatgatggttgatgggcgttcacaacagactgaagataggagactcccctggaatgctctggacaagcccttgggactctcgtgtggctctaaaaggagcagtccctccaagaatgacagattttggacatctggtatacccttgcaaatagggccactaagccaaatttaatttggttcagaaaaacagaataatgtgatgtttgatgaaaaaaaaaaaaaaaacagcaaatgctaacagataggcagaaataggtatccggacttggaagtagaagacataaagaggcataaagatgtggaagatgtgggagcaaatcactttttctttggttgagcttcagatgaagttaggaggcttgaatttatgagccatgctgtatgcaaaatgtgtaactttaaatgctggccctataagaacagcataacagcataaagatttcaccttaatgtaaggaagaaccttctgatcagtaactagatgatgataaaatgggtcattcaagaggtagcaagttccgcatccctgcagatattcaagcaaaagctgggaccccttcttcaggaatgttatggagcagattccagcatggagtttgaggctagactagatcatttttatattgaacaggctgattttctgtagtttaatgaatgaaacagtgactgcctatactaatagtttaaaataccattttaaataactattggctatattaaattaaaggcacttggcaagtcaaattcccagcttgtacctatacccagggtcactttataattcagctctcagggtccctgttcattatcccaagctatctggcagcaaaacctttcaatatccaaacaagtgcctcctccctacaggaaagtaccgttcctgtaatatatcctttaagatcatggtaatagttgtccttggacaagtctctgtaggttactttctttattattttatcaagtatgtcaattactgcctagactgcaattgtaaagaactataaatacacttatgttatacattatcagacaacgaaagtgaatatcattgatgaatgtgcttgttcaccctgttctactttgcaaaccagttagcttttgtttggctgacacagcattcttcaaaaaattgtagcagggtacttttagggaatgcatgcctggctcctgcttgtcacagctctcatcgggtccaacggtattacacgactgcttcacacttcacagagactatcatttcctatggatctacctttgacagtcgtctaggatggctaccaaatgagagccatttaatctcagtgggtttatagagtgtcaaacacaaacaattgccccttgttatttacctgctttgtgcccatgcctctggctggcaaatgctagaagcaggtcttaccctacatgtgcagccctctgtctgctctcaacaggtttccaagcaccttgtgtaataagtacttgtcaaactgaatcaaagactatgtgttccctcagcataggactgagaatcggaaatacttacagatggatggacacaaaaatgcagactaaatttaaaatgactgtgaaaatgaatgttgcagggtggtcttgaagatatagatgtgttcagaaaacaaaagctggtgtagccaggcatgatggctggtgcctgtagacccagctattgaccggctgaggtgggaggatcacttgagcccaggattttgaattcagcctgggcaacatagtaagaccccatctttaaaaaaaaaaaaaaaagctgatgttgataatgaagcattatactagcaatagaaacgaggatgcatgtaggaacttccttcttactacaaagctttaacaggccatggaagatacaagagaaaggtttgtgtgccaggagaaaacctgaggcctgccacctatagcttccaagacatattggggacaattgtggtctgggtagggtttgctttcccaaaagctcacaggtggtcacagcagcaccagaccttatgcttctcttgttgcaacctctcttctaaatgcctggaacagtgctgggcacaaaatcatccaagcatagttattgatggcttgattacaatttcctagcaatgagatgcacatagtttacaaaatgtctgcaaatgtggtgattcttaccttccaagtctcatgatatcacaaactgaatagcagttttgcctcacatccttttccaaagaggtcgccaatgttgattcatccctttcttggtgaagtttgcataaatgagggtgggactcaggagaatgtgtcaaggaactggcccaaggtctctctctgttttggccccattgtgcctctctgatggccttttgggaagactctggcctgagacccaggccttcccctgcatctggggaggcactgtccctccagctgtcctcttgatccaggatggggctggtacatgagtcagtacatgttgccctggtgaattctttgtcagctgagagttcaggtgtctattaaaagaaatgctactaattactggctgcgggatgcacattgtttttttaaaaatacaaagcttttttcccccatgtgattatagatcagagtagttacaagatgggctttgaggtctgtctatcaccatagcatcccagctcctccacatgctcccagctggacactgggcaacacactcaggcaccttagcttagggggctttggaagctctccataaatgtgagccttatttttaaataaaaaatatttgcaaaatttagacaaagataaaaatggaagataaatatgcaaaacaatgactctattccactttccgataagaaatgtttctttttaagtttttcatcttcatctgtcatctcagggcttgtctccctgtctccacccccatcaaggtgatgttctttcctgggtctcctcctcactttcccagacatgacttgcttcgtctcaactgctcacctccctgtcagccttttaggttctggttttgatgatgtgctatgtcttgctgccactgcttgaccttctacagaaaaacaatctgtgtttcagtagaaaactgtttttatctacagcagaacttgctgggttctctgattctggctgtctccactgtctttgagctattttacaactctataaataaacaggtcctttgaaatctcttttgagccagttttaacatctgcctggttccctcactgaatgagttaaataaaatctttaacgtgttcatttttatatctgtaggaatcatgattttaccttttcctgaaaattatcttccagcacttccaccccatgatctccatacctgatgtaatagagcccatgcctgggttcccacccctgccctcacctacaaaagaagaaccaccccaatgagtggtctccccacatttctgattgtacatccctaacaatgagagggatacacctccaaatgtgcacatttatttaattataaatcataaacatttactactcttctgatagactggacattataaaggatacaccaaaaatcaaaattttaagaagaccatattttgtcacattttcatactctttggagagacctccaaaatctgttttctaacctatcctctccttctagctcattatccctggacatgctctccagcaatccttccccactccaagacctccagtctgtggagctgctgcttttcatcattacccccactccccttccctgtcacacatgtcctcggtgtgcctcttattctgcttagattccatggctctgcccctagatgctcacttacagacaaggaagaccctgagctcccacctccttgcccctctcttcctccatcacgtgtcacttgcagattctgagtttccattttaattcctactcaaactgtgtgaacctcacccctgcttctgagcctctgactagattagcttcaagtgtgtgactgcagatgtcaaatgggcagtcaagacttccacataatctttgtctgtgtccttaatcaattcagttttctacctctgctctctaaattatttctcatcttgtctctctcttcaagtttctaacaactccaccctgaccttgcctgtgacctcacagtgagaatggacacgttcagatgagaactcttcatcttcccacagcaaattccactgagcagcctgtgcccctaccccaacttcagcttccacctctcaccacccatttctgtgctctacttcatggcagcctcttagatgagtgtctcttctcaccgtttccacgcctccctccttctttcttgcacccactagcaccagccttctgtccttaccacccaagggaaggagcccacatcagggtccccagcgacctctatctttctaaagctgaagaacaatattttgtcctttcactctctctctcagcaacgttcaacaaagtgtgtccctccctccttcctgagagcttccttgctcattagccctacttacatggagttgaccatgagccccacccttgcttggtttttccaccaattcccaggccccatcttaatctcatatgttgtcccatctctgtaccaggcctctcaatgttgttatgctctgtgctgacttctcagtcctctccttgaacttatctgcactctttcccaaggtgatctcaaccatttcatggctttacacgacctctatatatgctgacaactcccaaattcacttttcccagccccgatctcatgcctattctccacaactgcctaatagactcttcactggatagcctataaacatctcagttttaaatgataccaagaactattgtttctcttccatgcaccccagatggccttccccagcccctgtaagcagtccctctcttgggaactggtaccaagagagatgaagtggaaaataggatctatgattaccctcctaaagcatgaaataggtatatgtgatctagtgcaaagaagagaggtattggaatcaggaaaatcaggctttttaccttcttacccctccttcaccctgcattggtggtagcaccatttccccaaggcttcctcgtgccaaagcttgattgctctctttcctcatgcctgtttctaatcccaaagtagtctcctgaactccgcctcccagatgtatcccaaatctggctgcttcttaacacttcagctacagcctgagtccaagccacatcatgtttgacctgaatgactgctgcttgacctcctttagtccctgtgcaccagtaacccgagtggcccctctgaagaacggaggagggcatttcctgcttaaccctccatgccagcccagtggcttcccactgcatgcaggatggtggcatcatgctcctctgatccccaaggccctccagggtccctgccacctccacaacttcctccacttctgcttcattaacgatggcccaagcacacttgtatttttgtccctcaaacatccaagtgggttcccatctcagggcctttgttcatgctgttccttctgcctggaatgcccttaccccaaatgtgggcatggctgcctccttctcagaggtgctttactttatggactaaatgcttgctccccagagctgctgacccttgttctgcaatctgaccactggagccacccaagcaaatcacaatcctcccacttggccttcgggtatgaggagggaaagctcacccccacacctcacctggacccttcctgctagatctttatgggctctcctgggaggagctattctccaggatggaaataccacttttttccctgggatttcctagatatttcaacaaaaacacagggtcccagcaccttggcctgaatttgtgtgtgtgaaatttggccctctctcacctggttcggtttcttaacacaattgctgctgtctaccttcttttccaacccagcaacttttggatatctttcccatagctcttccctccctagaggctatgtcaaatgacctcttggagtctaagcatcaacaggatctgggacatcaagtcctttatgttgtcctagtgatggtgtcaccctcaggcacaataagtgatcacttttatccacatcctagagatgaggaatcatggggcctagagaggacaggcaactgcccaaggcccatgcagcacagcaggtacaggtgatccaggtacccgcccagatccccctccaggactgagattcgcatcctactgcctcatctcccctcccctggggcagcccacaccccagcgctggttagggcaacaagcaaaggcacaggttctcttgtcccaattcatggcagctccaaggggccatctctgctccagggctccctccagaatcagctgaggccctgtttatagctgcacattgatctctccttctgccccaccccacctcagtcaccctcacaggggatgttctcaagcgcaggccccataaaacctcccacgctcacatctctgctgcaaaatctgtttcctaggaaccccacagaaggcatggcaatgggtaattgtatctgtcaacttggctaggccatggtacacagataggcggtcacataccatctagatgtcactgtgaaggtatttttttttagatgtgatttgacatttaaatcagcaaactttgagtaaaacagattgtcttccataatgtagtgggcctcatgctgtcagctgaagcccttaagaggaaagactgacctctctgaggaggagggagttctgcctccagaccacctttgggcttgatctccatcaattattctctgggtctccagcctgctggcctcccctgtagaattggactggccagccctcaaaatcacatgaaccaattcctataataaatctctttctctcactctcttcatatataaacacacacataaacacacacacacacacacacactcattctatctgttctatttctctgagaacctgactaatatatgtgtcaaggtaaaaatccctattttcctgattccaatggctctcttctttgaaccagactgcacgtgcctatttcatgctttaggagggtaatcatatatcctattttccacatcatctctcagaatggaaattcttattggaaattcccttggtctgcttctgtgtctactctccttcttcccaggcttccctctctgatgcctgagcttccagagagcctggccctaaaagtttcacagccaaagtctaaacatgtaaacatctacaagaagacccaaatgtcagaagaggcagaatcagggagaggaaggagacctactgaggtttgggggccagctattttcctacccctgtgaaaggaggtggcactgaacctatctacaaccctcttaggaccctagagtctggaaaaggggggcccaaccagagccaggtagagagagtagaagacactgcagcctacctgccattcctgctccatctcaggcagcgcacctggagggggtcggcaaaggaggagcgtgacttcctgtggggcccctctcagtaaatgcagcacctcctgcgagaaaccaagattcactgttagatttgggcttgcattgctggggatgcagtgatgttctccccactgcgtcccaggcactagctcctcctccctgcaccttgatctatttctcactccagagaactccggagaaccctgctgtgggcctgacttttcaaagtgcaaggaaccaaggtcagtggcctgcagcttccacaaagttgatgcaagatgctgggctgtgcatcacctttgtgcagcttgggttctgggaacctctcatctgtaatattgcagtaacctcctctccgctccctgccttcaccagtgtcacccacctgcctccttccacattgctcaagggaatggcaatatctgccaataccaatgccttttcttcagagagagaaagaatgactccaacaaatagctgttcatctcaattgccctttcctcccaacctgccctcatcttgggccaccaattttgcagcctccaccatctgaatctctaaagcctgacccttggctctgagcttcctatcagggctcggcttgggctctgggaacctctcacctgtagtattgcagtgacctcctcactgcttgctgccttctccagtgtcacccacctgcctccctctgcaatgctcaagggtagttttccacagtgcagatataactgagtccttcccccactgcacaccctggctgactcacttttccctcaatgtaagctccaaggcatagcacatagaccccgtttctgcctgcctctgcctctcaccacagttccctctctcccatctactcccctctgcacccacgtcctaagcccctgccatgctgaatctgttgctccaagccaccctctcaatgtccagggttcaaggttgcctcgatagctcctatttcctatttagaccaggatttctcaaactcttggcactgttgacctctcaggctggacaattccttatgcgaatgcctgtcctgtgcattgtagggtgtttagcagcatctctgatctctactcactagatgccagaagcactcatcagttgtgacaatcacaaatgtctctggacttaatcaaatatcccatgagaaggaaataatctctgcttaagaactgctgatcaagacactccccagtccctgcttcagccacgcaggacttccaaggggtgcacttctttcctggctcactggtgtgagcactgcagcatgggctttcatctctcaggatacatatctcctgccatcaccgctgttttctgtccatgagctctgaaactgcatgagctgtcttcctctgtgtcttcagtctctcatagagttgccagcccagcagtggttctcagagaagggttcttggatcaggagatggatggatgaaggcatgccctcccacccaagcatatggtgttctagagacctccccccagccctgcccagagccactgtccccctttgtccatcttgctttgtgtttctggagctgacttataaaggctgcatgaggcttcctgttgggctcagctaggggaacacggcaagagaccagagacagggaggagcggaggtcattgctccttccaaattcctcccttcaggttgccatgggacgactacaacctcagccaaagtgagagctcatgccagcgagtcccctccaacagctctccattcctggggtggaataactgctctttcccttcccctttggcctcaggataggggtaactgcatcccactcttcctatcctagccctaggccacaacatgctcccttgagcttcctaacaacctgcccacacctttattaaatgttcctcaaatgactccattttcttccaggactctgtctaatatatacagtatttcattactctctcttcttaaattgcattttttatcatagacaggacaatcagtgtaataatgtatgaaaagctgtaaatgtgttgagaaatgggaaggagagcagaaagggacccactctagtcccttcagccccacgcccacctcccaggatgtgtgtgaagagacgtcagccagcacaaaggccagggctttatcttcagcttctctcatgaacccagtgagaagcaaggctgactcaaggtcagatatttaaaaacagagattttaaattaaatgtgagcatgtaccactaattactctctttgtgtgattaaaatccgggctgctggtgtgatttttgagagcccagagttttccccacggcagcaggctagtaagaggcaaagctggggccagcctgcacagagagctgcattgcccatgacccccggcacctggaagatgaggccttccgtggaccttccattcacggccaggataatgtcaccagctgcaatggccccattctcctcagctggctgccccggaaagagcctcttaatcctcacaagatcacttttgagatggctgcagctctctttctccatctgcacgaaactgaatcccaaaccattggcattcttttttagtttgacttcaaacttaggacctgtagtgtgggatgttgataaaaataaattcttcagtagattacaagtgaaattgaccagtctcaaaatgcagattgtcaagtagatgaattatttcttttacgttcaaataattcctttgctaattttatgacagagtacattatgtatgttatagattagtgctgtccaataaaatataatgtgagctataaatacaaaccacaaatgtcattttgaagttttcaaatagctacattaaaataaaaggaaaaagcaaacaaaaaataaataaaacaatttaaaaagtaaaaggaaacaggttaaatacgctataatcgtacatctaatttaatcccatatatctaaaatattaccacttcaacatgtcatcaatatgaaaaaattattaacgagatattttttattcttcttacgaactaagctttcaaaatccaatacatattttatccatttagattggtcacatttcaagtcctcaataaccacatgtggcaagtggctaccatattgaatagcacaattatagataactcaactatgtttatacataaagatatagctgctaggcatacacaacatgctcttggcatttaataaaacttgtatcacatacattcctattactcctttagaactctagtcatttgtagtatacttgaaactaaattttgaataattagaccatggagaaaattatggccaattctatggacaatgctttagctgccattttgtttacccatgtaggctgaccataagacaaaacagttgcctctgggcaccaaggatgaacagagctggcaacctacatggtctgtccaccaaagaggcctctgggctgccccgctggcatcaatgcacagagggacagagcacagcttgcaaacttcaccagggcaagaatggaagcatgtgaagcaattatgtgaagcaattatgtgaaggtgtgtcacacgaccagttctaccatcgccctaaggcctcctccactctttggagtccatttctcaaaggccccaagggagtgagcaaaggggtgaggacagaggagacttgatttaaacagaagcatgcccctttgccccacccctaccctatggctggcttgagtcttctgcagcaaaatcagaaaatctctatgaagggactaaaacatggctaaggtccaaatcgttcttactgaggaaatcagcgtgttcctggcaaataccaaaatcacaagggaattgcagatgggcagcccatcggaaaacgtgcagttttgtccctctaaatgatcgttcgtttgccttttaaaatgatgctaataacaaggctagattcctgaaccttctctcccaacctgcctagtcattcctcaaataactttgttacaaatgacttggctggactgtgaagccaaatgtatctgaaagtgtatgaccctttcagtcaatttcatcctaaatattcacacaaacattaacattctggcagctgatcaaaggactgaggaaggctgggggcagaaagatgcctagaaatcatttggggaaaatgcatttgtttccagaaacctattccatgagatgggcttccatggcatgaaaaagccgatctcagcatgatcaccatggctcgctttcttttcaggacccagaggaagccttcctgcctttcccttttgacttgacaattcaaaagcggcacacaataacatgacaatagtaacactcaattctctcccctctcaccatctgtcaccgagacacagctcgaaggcctgccaggcaaggctgttaccaaggaaacagccgtgcgttcatctcccatgctgtcattagcagaaggacactgctgtgtactcctggggactcttctctctaagaccagtcttgcaacctagaaggaaaggtgaacaaactcagtttacacttcatatggcaaccaggaggcactcccttgactctgcaaatgcttcttaattttcgaatccttcctataagcagactcatttgaatctctcaactagcctatatattgggatctagacccagatttctcagtgcttattagacaagtgcacctgaaagcaacacatgtacctccacttcacacatgcagtgccacactcatcttcctcccctcactcaccctcacttcccctcctcattcttcctaaaacactcctcccctcgcattggctcaccccaccattaacctgccaagggccacatttggagtggtccagctctcccccatctggtttctaagatgtgaacattccccatcaagaacagctcctcagtgccccctcccctccacctcctctctcactgccagtgacccgctgggccgtggcaagctctggttaccttggctcgctggaccctgtctgcaaccttcttggtccaccccatcatggctgccagtgaattggtctaagacaaaaactgaacatgcaacattcttgatttgaagtctccaatgcttcccatcacctaagacccaaacccatggcaccccaggtctgtaccacctgccctcccctttctttccaatgtgatttcccacatttctccccacaacaccatatacccttgtcgccctaagtgtgattcaagaaccagcagatagacatcacctggaagcttctcagaaatgccaagctcccattcagggcatgtggccctgccttcatcttcctgttgcacctgtcactcagcacctggcccaggatcccagagggacaattcctacctgcttaagctgccaggaggccagccaagtaccctctctacccatgctcattagcaaaggtctaaatatcagaaggtgccaataaattatggctctgttctcaagataggtcaaccaaagtcactaatataagcaaatttcaccagacaccagaaaaacgctttgggaaagaaagcgaaaagtggccagaacattgccccaagcttgctggaagggccttcaggaatccctcctgtctctgttgactttttagttgccaaaagagggtgatgccagctctgtggctcaggacacagaggcagttagaggctcctaacctcaggcagaggactcggcacagtgggataacatcgagtcactgcggggcagggaataaaggggacataaaggatgaatggctctgctcttggcaccctgaattcctacctcattgtgaggaaaagaatcccaggacactctgacccacgccccggtgggtacaacacagggtgagggggaatggcatgaacagggaatggagtggggtcatcccatgcaaacgtagggaggtaagaaggcccatggtcacagggccagcggggctggggcagccagagccaggctagagcagtctcttcactccatcttctccattccgctgtctgattccagaattcaggcaagccaccagtaagtttctaaggctatctatggggggtgagattttttttactcagaaacatctatctgctatctcctgggtttcacatccccatagaaaagtgagggtaagaagaaatggaagagaaaaaaaaaactaacaaagaaaaagtcttgtttcctgcctgcctccctcccacccagaggcgatttcagcttctgatgttgttcaggaaagttccggaaggaggggaagctggtcagcaacagtccactcacctgcccaggacccttcaggcactgcacagcctgcttgtgggtgaggccgcacagaatcactccatccacctgcaggagtcggtcacctgggaaagggatagatgtcatgtcatgacctggtgcttgaggctgcaggaggttcccttccaggaggaccctgcccggcacccctccatgcagcctggagaagtgggaaaggaagctgaggtgccaggtgtccccctggagtcagcaggaatcctgcctctctgagcagtctcactcccttcttctcaggcacatcacagatcagggatataaaagcctttctattattggctcacagaatggttgagccagctctgttcaaccttatccttcctcctgttttcctgtgaaaccgtttttgaaagtattttcaagtcacttagatatttatatctccaggatgtattttttttatttcaaaaaaaggtcagggaggcatggttgacgctggggacaccagaattctaggggaaatggagataagtaagatcctaggttccccttttggctcaattctggcagttttggagaccaataaaaatcacccccttccatcagagaagtgggagctgagcaagggcaaacagaaggctcaggtgtcctccccggatgtgcgagtgagtttaccgaggcccacttgtcctccaagggaagcagtatgttttcccatggaggccaaagagcaacacaagtcttttaagtcttctactatttttctatcacctatgcttcccagtgtgccactgcagaccccccaacctatcaaatgggcagggcagattctatcacctcctttccaggtgagaaaagtatgacctggggaggcaatcatttgcatgagttttcagaatgggagcagggcaaggcctagaggctgcccctcccagtgcagggctctttacaccatggagcacagagttcccaatgaggacccatccccatctctcaccctgtaggatctgcccttccttggcagctggtcttccaggaacaatggatttcacatagataccaccatatggcacactggtgttaatgccaccctgaaaaacacaacaaaaaactcaccacccatctttcctcctccaggaagcctccccaacctccccagctaagggaatccccacctgcccaccactctatcccatgaccttacctccgactggcactgtcttctgtattcacctgtttgtttagattgtattctccactgagcaataagattaggtgttcataagcttaacaatagcaactatgtgagagatctgggcatgtccccagcccaagcactggtacaaggcaggtgctcagcaactgctcacgtgggatgcaccactatctctatataggtagtgaccagcgtaggtggatatggctatgggcctgaaggcttgtgcctggcacgtcttgtgtgctttgatgggccaaaggatatgtgcatttttcattataatagatgttgccagattgcatccctatgtgaatatggatatacttattcacatttctaccagctttgtatgacagtaccatttttctacgttccaccagctgtatttggccaagctggtagacataaagtttaaaattttattttaatttaatttgtattcctgtggcttttcacgggtttgagtgtttttcatgtgtttaatggccatttggatttgagtgagacatttcaagaattatttttgaaattaaatatctgcaaagaaaatccaagtttttgccagccaaaggaaatcatcaacctcttctcagcaaatatatatttgtgaataacccaaaatttagtcagtttttcagatgaaaaatagctatgtttggtgtctgataaggctgttaccccaagccaagaataaatggaccatatttggtatcagcctgttcactccatgtggattcatgagccttattgcttggtttcttacttggtcccttaaaatcatctactgatgacaaattcattgcaggcttagggtccaagaaaacacatatccttgctctaggtacatagcattatcacaggggaaagcaaagaatgccctccattcacatatctcttgaatttcctctgaaaattttcatcagccatagagtgtccttactttggtgggagatgccattctatttcccatcaacagttaaatccaacaatgacattcctgaaatccagacccattccagggtctgaaggtaatggatcacttttttttttttttttttttgagacggagtctcactctgtcgcccaggctggagtgcagtgttgtgatctcggctcactgcaaactccacctcccaggttcacgccattctcctgcctcagcctcccgagtagctgggactacaggtgcccgctatcacatccagctaattttttttttttattttttagtagagatggggtttcaccatgttagccaggatagtctcaatctcctgaccttgcgatccacccgcctcggcctcccaaagttctgggattacagtcatgagccaccgagcccagcctgtaatggatcactttcaatactcagtaataaaagcagcaccttccaacctctgacctctggattttcaccagttttgtgtgtgccattccccaaccccttgggtaaacacagttatatgggtaatctcctttcacaagggtctaccaggcagagctcagaaaccaaatggaaagtgtcagtcctgatggaggcctggccctgggatgtctgagccagaggctccacactgattctatgctggatgacagtggactgccccacccatccttggccagatgacagtggactgcccttcttacctttagcttgtgtccctgaagccccaatgtgcttctctctctctgcagtccagcttgacctcagagtcaggacacatcagccaactctgcccacactgcctcctcatgagtttggagtcccctagtgcatgccctgctcatcctgaggttccccagtacctctgtttgtctctgaactcatcccccagtgcaggcccccattggcttttttatttaccccttacatttgtgcaaactaagcacactgtcagaggttgccatctgggtggaatggccaccaggttctagacggacatcttgttaactgcttttcaagctctcctaaaaactcttacagttacgctgaatccaagtgtcccatcttctttaaccagttccacaaagtagatttcaccagcactgatttctggaggtgatggaggacaagaagaaccagcaccctgccataaacaaacaaacaaaaataaagatgggatgaaggaagatgtcacctcttggctcatactgctctcaggagcaggcagcattgcacctcagaaagatcatgagttttggactgggccagcaggggattcatttccagctttatcaggccttctgcatgtgacctcagacaaagcaggaggaagatgagggagtgatgggctgggctgatgccacttctaggcagagaatgcttgggtcactgttcatgttccgctgtccctctgcctagaagatggggtcttttgtcctatctgccccctttacttagtgctttctaatcaccatgaatgttagaaaattctaacgacacgcaggaaaataaacaagctggaggaagctgaacaacgaagcctcaactgctgaggttgagacctgaagtgagaatctaaagtccaccataccacagaggatcatctggccacaaagttggccaagagacccagaagagcctgcagcatctgggttgcgtcctacagcctgcaccatggtcaacgtggccttagagctcccttgctcccctcaacggcccccagccccaggaaaccaactctcaggtttgccaccaaagaagccccagcatgaaggcctctctgctctgcttcctgccagagaggacctaccagaggaaggcctggggtgaaggtttctgctctggaggccaatctgaatcccagctctgtcccctgctccctgagagagcttgggtgtgctcctttgctctttctgtctcaggtaccccacccataaaaggggttgataataggaatgatctcattgggttaccatggagcttccatgagctaatacatataaagtgctcaggacactgcctggcacacaggtaagtactcaattaatggcagctactatcgttgttcttccactggcctcctgtatccagttcctcatgggatgttctgtccaggtgagcaccatggccaattaggaaggcactgtcattcatggagccctattgcatgccagatccttgtgacagaggtcaagacacactaccccaaaatagggcaccttggcacattggaggaattggagaaacagcacatgagggaaggtttctctgaccttcccctgcccttctcttctgaagcaggccctaaaacctaggaaggattttctaatcttcccccgaagcagggcacaagaccctcaagtgagaatgccctccctatatctggaaaaatggagcatcttatgtgggaagacacagggactgagagaggaatctgaacaagcaggccctgctgagttcctcccaccttacatactcctgctttttgtcttatctcatttctccatgactctccattcttcatcaaatatactcagggagaactgtttcttcaggtcatttccgtaagaaggctcacatgtcacataaaacttatagtaaatacacgtggatgcttttctctcattaatctgtctttagttacaggggtcccagctgatgaagctaagatgagtagaagaaagatacgggttttatccccgacactgggcatagtaccttagtttccacggctgtggacagacatcattatctccatcataaaaagagaaacaaggttgaaagaggtgcaataacctgcctgtttcaaccagcaagttgtcccagcaagaatgagaagggcatacactcagcctgagtaagggaggataggtcatgggagacctgttttcaaaggtcttgccagcctttggagaaaccagtaatatcagttcagcacctggggctagaaacactgggtgctgtgaccacccctgagcctgaagggcgagagaagggagtggtcgatggaccctcataggagctgtgctctttgtagaggggcacaggcaacctgtgtcagcacagggagagagtggaatgaagggtgtgcaactgagactccagcactgccaccctgtcctcactcatcccacaactgcgggctcctgctgaggctttgactgggcagaaccaagcagaacacagcaaggtgactcagtccatgagcaccagctgtgcagggcccagagcagaatggagaggctggggcatgggtctggcggggcctgagaagacaacaccactgggagtccaaagagacggcagaggacagcagagctgggactgaagcacacagccctccatacacctactccagatcccatcttcttcctccatggggtatggtcaagagcaaagccactgagttcccagcttgaggaccaattcaaggacaagaataggaggtgcctgattgcccacgccttgccattggcagcaatcaatttcctcatggtgctattatcacaacaattataattagtgactaaagactccagaggcacccacactgagcctgtgcccagacactgtcctagaactctgccttcttctatgcgtttttctcaacaaccatgccatgcaggcatttgcttctgtatgcaaatgaggaagctgtggctcaaacgggctaagtaacttccatccacctgacatggaaaacagagaacaggaagggcctaggggccaggctgttgggcttcacagtctgttctctttcatccagatctagaaagtaaaccaagggatgattacctttaacggcagaaaggaaagctgatgtctcagcctgggcactaagctctgcaccccagccatgtctagttcttcagtatttctgtcctggtcttgtgtgtgtgacaacaaacttccctggtacccgaagctcaggatgtctgtagaggagaccccagaattggctgtgctattcttttcttcatctgggttatttccaccaacacctataaaaacaagccaagaaaaagtcaacagcttaaaaaggctggtttcttggtggcatctctatgtgggcacagcgttttcctccagtgacagagtgatcgtttatagctgctcgggtacaatatgaatttagctcctcctgaaagatgttacatttagattagagaaagggaagattctacatgggatttagaaacctagatagagcttacgtgacccaactatgaatgcgtaggctcaaaagaagttcataaggccagctatcccttattaagctctagccatgtgatgggcaccttagatatacatataggaagatatggacatcttcccatcttctcagcaaacccaccaggaaggtgtaatcccagttcaaacatgagaaaacagagtcaaagctattaagtgtcctgccccaaatgctacagccagcatgtgggaactgtcttaaacccagcctctcctggacaccccactgagcacatctgcagccaccatgtgatccaaaaaccaatgtatcaggtccttttgggaggcttggtaataaccaaactgcaggcccctgtgagtgaaagctaggccactgattcctgctcaccctgtgtctgactcgtgacctggcatagaacaaagaaaagaacgtgaggttgctgatgtttatacattttgcatgtaattactaccatagaattatacacttaaaaatttttaaatgatgtatgtatatcatattgaaattttaaaaagcaaacaaataggaggtgcctaagcttgactcatgttcattaatttgctgacccctttattatggcagtggttaatatattttagaatttaaaattcacttaaaatatgtgttaaaagacagattgctgtttccttagtttctgattcattcatgctggaatggtacccaagaatttgcatttctaatacatttatgtatgatgtggatgctgttggtctgttgatcacacttaaaaaacttctagactacattatgcctaaaacagttcctctgtctcatcagtgcagttgtttaattgatttgttttttttttctccaagtaaagagattaagttattctaatctaataacatgctaatatagtttggctcagtcaggcaaaatcaatcatacatatgaaatcattaacagctgaaaagaaatagagagagacaaagttgggaagagattaaaagtgagagctgatgtgggattgcctggatgcaactaacatcccagttccatcacctttctcctctgtaacactggaacaggtaatgaacttccctgagatttagattcccttgcctgtaaaggagaataaataacaaaaattcctcatagagtattttgaggattacatgggatactgcttataaagttgctagcaaaatgtctggtacataacaagtcctaataaacagttacagatgaaaaaaagatggacagggaataacattcatgacaaatcaatctgaaaaatgttgatgtaaaaaattctagaactcaggatatcttcacaaagtcggtgtattaaaataaatatggcataaaccctccaatgtgagccttataaaaagaggagatttgcttattatgaaaaagagaaagagtggagggtctatgaggtaattattaatattagttttattaaatattagcacatttcattaagtgtgcagcaacctcaagctggtgttattaactgaacttgggagaacatttgagctcatgaactattcacattgttctaaatctaagtaaaaaagtgataaaagagagagtgcagaagctagttaaaatgtgttttccatatatataaatatacataatatataaataaatatatattatatataaataaacataaataaatttaatatttataaatttaacatttataaatatattatatattatatataaataaatatttataaatttaaaagttataaatatattataattatatataaatatttataaatttaaaattttatataaaaagatataaatatatatgtaaatatataatgtataatatatctaaatataaatatatttaataatatataatatatctaaatataaatatatttaataatatataatatataaaaatgtaaatatatttaataatatataaatagattatatatatataaatgtagctaacagttccaacaatgttcaaataaggcaaaggcccagctgcaaccaatccagttgtttctgtacctcactttccttttgctgtccataaatcttcttccaccacgtggctgcgctacagtctctctaaatctcctgtaattctgggcgctgcctgattctcccatcgttcattgctcaaactactttaaattttatatatatatatattttacacaaagaataggctgagttaaatatacatcttgctgtttgcagtgaccattctggcttatcattacagatgtcttgttttctcctatagaagtaacacactttactacttttcaagacagattgttacactgattctatgattgtcgttaagagaaaaatttcaaccaaattaaatgtaaagtagtatgagcaatgaatgatgggagaatcaggcagcacccagaattacagcacatttagagagactgtagcgcagccacgtggtggaagaagatttacggacagcaaaaggaatgtgaggtacagaaacaactggattggttgcagctgggtctttgccttatttgaacatggttggaactgttagatacatttggccaaaactcagtgattggtacagatgtgggctacagttggtttacaacttcacttgttatagttcacgatgtatagaaaaacctttaggttgaactttaatatgtaaggaggcagctttaggctaaatttgatttaacaatttccctctttgggtcattttctcaatcttgagatattgaccaaaactttagttattgatgttactattaccatggctcttgaaacttactgggaaagagcagaacagtgagtttggcaaagatgggaacaaggaccgagtagagggtatgtccatatgttggaacattctgtttacagaagaaaaacaaaacctggtctgttctagaatctgtttgctatgttttccatgatcaaacgtagtttgattatgttacattcagcacaagcaaccccagttttgtctggtttggtctgttggggcctagtgcatgagctcagtccaaaacaatggcctcccataatttcatttaaaagaatccccttttttttaggtcatgttctcacttaggtgagagtgtgaccaaacttagggccttagcaccactctcagttaccatcattgtggatttctggtctcagcatgtcattcataagttacggtgtcctcatggctgcacatttctttcagctcttgtcattccagttaaagagagaccatttgacatgctagagatgtctgcatgcaaacatttaacacttttaaagagaatatagcacaccagaaagactattattatgactatcagtaggataataccaagagtttggagtgtgctccttacccggggtccccataaaccaaaccacccaaaattaaatagatcaaaggatgagctacatgaagagtctactcacttaactaaagagtctcggccgggcgcggtggctcatgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgaggcgagatcccgccactgcactccagcctgggcgacagagcgagactccgtctcaaaaaaaaaaaaaaaaaagagtctcttcattaatcccctacaactaaatctataatatgtgatgttttccccataggccataagtgccagcagctgtacagatacttctgtttagctagtaacttatccagatcaattctattatttagcataactttcacaagagaatttaaagtttattgtgtaaccatagcctttacagtagaatctgctttagagcctatcatgaggaatacatttttaatctttgccgcttttattccaaactatggaaaaaggacctaacaaatgatgcccttttagaagagtgaaagcctcccagcgatgttctccttaacccatgatgtgggttaagaggagtaaatcaatgttctgtttctgactgattatgaggcaatgtacgtaccattaaagtttctcatctacattgggccttcatttttgtctattaaggtataaggttatccatgtataaggctggctgcaaaatccttcacaaataaaagtataccccataaatgcacacaagagaaccctttcacttctattattcatagaagcataagcaagggacaaataatcaaagataagagtctcatgatagtagagaattcttgatccatgatcttgggaaaacctgttcacagtcaaggatgccatcttctggggagaaacccccctggttagcttttctttaaggcttctaatgggtgtacagttccaagagtgtaaagggagccttctcagttgtgagattatgaacccaaggttcaaggtcctgaagttttactgtagtgtgcatgccaatgacagtctttctttgatgttctcagaagatcagtcttcaggttctagtttatgaaggcattgattgtcctcagtgaaccataaaaaccttactttacctggtaaaaatacactgtagtataattatctactgctacaaagatggcagtggcaccccatctggagcagccactgccgtcacatcagctacagaggtgaaacatggtaaagagctggatacaagtgggaaacatgccccttctgagttggtggagttagagcttcctgggaacagttgcagcagcccaagtagtggctgcagatctgggcctcccattccatggagcacacaggacacctgtccttcaagatgcaactacagatgcccaagccacggctgcagagtcaggcatctctacactcttgggggcacaggaaaaaaccccaggcccttgcagacttggaggtatcttctgctcccattgcctggctcctccccactcttgacatctgctctgatcttggagcaaggttgtgggtaggctcaggtgctgttgcagcctggtgggtgtgcacatgcttgaggcagtgctgatacaccagtaccatactgtctctggcccctgcccaggctttgggcactgacaagcatgggagggaagctgaggagatgctgagggcagcttggcactggcctgcaggcatcctttggcacaaatagcctgggtgccatgaatggcagcaggaggcagacaggctcctgcacagaagggggtgggtccttggtgaggcctttccttcaggccaggatgggtgtgaaggctggggtctgggctgccagtcccgtgaaccagagtgtaaacttgtgatgccttttctggggccatccatggcctctcatggaccgatcagtgtgcatttcttcctttctgagacctataaaagccccaggctcagccagaactgagcagacattgggacaaccagctacagagagcagctacccactccagggcctcatctcttctgagagatgcagatattgggatgcccagctgcagaatggaggtgcccactccaggacatcctctgagttattctgtcactcaatatagctcctctttgctcactctccacttgtctatatacctcattcttcctggaggtagcacaagaacttgggacttgccaaatgacaggactaaaaatgctgtaacacaaacaaggttgaaacatgccccttgctcaccatgttgtggatgacaagaagagagaagaaaaaaagagctgtggctctatgggaacccagacctgggagctccccaggccagagctgtgactcccgctatgggaccctgtggttcctggagtctgcaagcttccaggtacaactgtgttcccttgtaacagccatggaagctgcttgtggtgtgtctggtccagccaaagccttatagtgagctagcactcatgctggcacctggagctgcctgtcccagctgcagcagctggtgtgcctaactgtgttaaaatatattgaacaatatgaacttccactcaccaagcctgacttgattgctcagtctaccagtagcagaggacaatattgagcccctgatatggtgacattccctggagtaatcggctggctgcctgggggcaggctgattacatggtatgaatttcatcatggaagtagcagcattttgttcttataggaatagacacttactttgaatacggattgccttccctgcatgcagtgcctcttcccaaactaccataagagacttacgaatgccttatacactatcacagtgtatcacacaccattgcgtgtgatcaaataagtcacttcctagcaatagatgtcagcaatgggcccacgcttatgatccaatggtcttaccatgttccgcatgactctgaagcaattggattgatagaatggtggaatagcctgttaaaaactctgctgcagcaccagctaggtggcaatgtcttgcagaattgggacaaattctccagaaggctgtatatgctctgaatcagcattcaatatatggtgctgtttttaccatagcagaattcatggctccaggaatgaaggagtgtaaatgagagtgacagagttcactattacttacctgtagtgactcagtagcaagatggttgcttcctgttttcatgactttatcatataatatgagatgtactgaatttgtttcatagtatttaagtaatcctaattttacatcatagtatttaagttaggggatatcaagaagagtaaacattactcaatgactttgcttcctctttctgggaagggattagtgcaatttttggtgtatacaggatagttgtatcctgtcaggcagaattatgaccttgctattgtgtttatttgaaaattaaatatggttttaaaagatacatataggtgccacattgacacagaataaacttataatagctagttttatgtgttggcttgactaggccatggagtgctcagatatggaaacaaatactattgagtgtatctgcaaggatgttctagatgagattgatatttaagttcatagagtgagtaaagcagattgttctctctaaagtaggtaggccttatccagtcaattgaagacctgaatagcacaaaacagttgattaagggaggactcctcttgcctggcttcctgagctgggccattggtcttttcttgcttttatattcaaatggaaacatggattttctcgggtattgagcttgccagcctttggactgaagcttacactatcaggtctggttctcatgcctttggactcaaactagaactaaatttcagcttttctgtgtctccagcttgccaattgcagatattgaaacttatcagcctccataatatgtgagccaatttcttgtaatctctctttctctctctctccctctctctctctctctcaatattgagagcagtatacacagctaagatagtcatggaatggacatgatgactctattactcaatgttatctagagaaacatatgatgagcaagaaaggataagaaattggctcacaccatccttatagaggctgagaagtctcaatatctgtagttggcaagctggagacacaggagagattaaatgtagttccagtttgagtccaaaggcatgagaaccaggagagctggtagagtaagattcagtccaaaagctggcaggctcaatacccaaaaaagacaatgtttctatttgaaacattgaaaaggaatcctctcttaatcaactttatttgtgctattcacctcttcaattgattggaaagggctacctacactagagagaacaatctgctttcctcactccatgaatttaaatattaatcttatctagaacatccttgcagatacacttaatatcatttgtcagcatatctgggtacccatagcctagtcaaatcaacacataaaattagctattataagttcatcccctgtcaacctggcagccatgtgtctcctaaaaccatacttaattgtcaattaaagaaaatagcaaggtcataattctgcctgatgtgatacaactatcctgtggcaaccaaaaatgcactaaccccttccctagaagaggaagcaaagtccttgagtggatgagggctgcctactttgaatatacatggatgtgtataaatacacatttttttctgttcctctagataaccttgactaatacaatcatcatgttcattccctgactatcttagctgaaacagagactaccagtcagtactcttattgcccccgatttgtttattgaatgtacttgctaaaatccaaaaaatacaaatttacttattgtctacatcaaatataatgcaatcactatgggagtaagtactttgtatctctttttacatcacagaatagattgcataacataaaagtgatgctcaacaattacttgttaacctagttttgattaaaacattctgtagagttcaaaaggttctatttttgcatatatgttccctttgtttttataaataaataaattatattaacttaaaaataatggatataatggctttgaaaattctgagactcaccagatggcaaatgatgctgaaatgaataaatagctttcaagcaaagatagaatccagggcactgccaggaaagtatggtccaaaattgtagccaaaaagataactgtaaaattttccatatgttgcaggaagatcaaaggttgtgctttggaatgccatttagttagacatacggtcctctaaaatataaagtatatgatatacagataactcaatcgaacaatggaacctgcaggaagctcacagcattgctctgcagcctcctcaacaaaagttcaagaaagagaagggcatgtttctgaaagtattactgagttaccctttgtgtatgagtgaatctcagtaagattcacagtaaacctacaaaaatttgaaggtaaattacatatgtaaaaatattgataatttaaactgaataagccagattcattttaaagtgggccacccaagtttctttaagcagatagcaggctgagtaaactactcagagttaaatatgttctaacttttatgaaaaagtaggctatttcaaaggataggactgagaccagacggtggaatcaagaaatagccattgattggtaggaataggattaaattcccctcaaaaaaaaagaaaaaattaacattttcccagctagatttcagaactctcattgactgctgacttctgtatgtctccctttttcctctattaagtccgagtgtctatgatgattattctatgcctgtctcatcattttatgatagatgtgtgaaagataggtaagttgtttctttagtttcaaaggtcttcaaatcaagacaaactgtactcaaggagttgtatttgcagctagacctgatttaaatgacaagattctagacttcaaactaatgctgtgatgagatgaagctttggtagacttaggatacaattagtgaggtgtgtgcattacttggagccagagagcagtctacagtaaccggcctctaagaaggaccccaatggacattacctccaggtattcatgcactggtatagttgcctcccgcagtgtaccagggttcatctatatgaccagtagaatatgccagtagtgatggtatgtcatttctaagatgatactatttggcactcaagggttagccttctgggaaacatagagtttgggattttaaatttagaaactgaagcaacttttattctggtagttacatgctctcattactgcttctctctatatatttctaataataattaatttaattaaatatcttcttcttctcaccatacaattttttcatattttactattggtaatgattttaactactacagatgtggtctgtatctatctgcctatttatctgtgtctctacaagtgcataaatgtgtgtgtggtgtgtggaggggagtgtatgtatatgtgtgcttataagttcatggatgaattacaaagctttcatatgtgcatttcagtttactcagaagttagcaaatttatttttggacattttaacctctgtattactatgaaaagatccacatttccattttcatgtaatctctttctttctccctctgtcacacacacacacacacacatacacacacacacacacaccccccacactccaaacaattcttcatttgtgtagatttgtgtattaccctcttcttggttttgtgtctctaaattatttacttaaatattaagttagttaatttaattgtgttccccctctataatttccatatacggtttacctttgaaccatataggtttgaactgcatgggttcacagatacatggattttcttctgcctctgccatccctgagacagcaagatcaatccctcctcttcttgtgcctcagcctactcaacatgaagatgatgaggatgaagacctttatgatgatccgtttccactcagtgaatagtgaagatcttgtaattctcttaataacattttctctcactttctttattgtgagaatgcagtgtataatacatataacatgcatgacatatgttaattgtttatgttattggaaaggcttctgatcaacagtaggctattattatattaccagcagttaaagtcaaaagtgatacagtgatttttgacttcatagaggtcagcaccctaaccactgtgttgttcaagggttaactgaaaacgcactggattgcatgagcataagataataatgagaccttaactactttccagctgaggtaggggaatttaaattctgcataatatctgctgtcaatagatttgcccagtaaagttttgtatcaaataagttctaagtcttatttcacatttttatctcagtttctaaatctgccattattacattggatttaggagcaaaatccattataaaaaacctgttctaacaagaagactgttttttggtagtctcttaaacttcatattgggtgaagattatgctccttgaggataagattcatactgtaacaattttctatatcctccacaatgttttgcagattcaataactatttaatgaattaagttaaatttacctatactcttacaagtcttactctcataaataaccttctaatccgcaattcctctaaaacatacaaaaaattgccaatataaaaaagcaagaaagaaggtgttaaccattttgtcattcaaaatatgactcattctttcttatacaactacctttgtcagcattcttgccattggactgtctagcctttgacactgttatatcatggcttgtcgttagagaaggtaaagtttggaaaaaagaagcagttacgtaaagcaatgttagaaaatccttgagtttcccttagaattttgtgtcttctacgtgttttctatttcacatagattaagtttgcagagttgtgtcataatttcatgagtgtatctgtcaaagagccctttgaaggcctatttaatccaactaagaccattttttcttgttttaataccattaatcttgttctctctttgataactgagggaaaagagaaagacattccatataatacatcagatgcctaagtgctttggatagtcataagccttttctcctatagcttcctaattagaaatgcctgctctgcggagttttcttaagttttccaacttgctccttccattttataatagtctattgaggaagactattatcaaataaaaatcagaatgatcactggacacctattttagccttgggatttatatcacaattccctaagacttcatatttccagaaaagaaattcaaactaaagctcacaattactattattatggtaatcctgataagatgtacattttaactaaaagaagttcccactattttttttctttctacttttcaataatccttgggaccttagtaggagtgtgcaatagtcttgtggtgtatttttagtttaaaagtctatctgattaccacttggtagatattgtccaaactcacttttgaatccaagtgtttttacccttatataatttttttaaaagagtatttgcttgtttctattatactataactattggagctactaggaggccttttaaatttcaacaacaaataggcagaatggagactaactgaagggttgatgggcttaaagaaaataaataacctaacaaaggctaatggcaaaaccaacattagaaaccaagtcactttacttgggattagtggataccaaaatgtgctttctcggaagcagcactttacaaggaaacatgaaaatccacctttgttgtccttcagctaaagggaataaaatcgtgtactttctgtaattttaaccttgttataacagatgctacagaaactcaagtggaactctgactgccttgagagctgaataaaatgcatcctaccatccattgctgctgcatcaaggtattaaaaagagagacagaaggaagaggcgagagaggcacaagttcaacagtgtgagggacttggacacaatgggagggagaaagaaataaatgtctaaatgtcatggaaagaacagacaatgaaggcatatgtaagaggcctgctaaagctatgggacctcagaagcctatttgtaagaactacaatttagaataaggaacttgcaatacaatgcctgaccttcatttccttacgtgcctcaatcttgtcaaaacctttgattgatttttgtatgaacatgaattactgctacaatactcagttgaactacatgaatttctcaaagcagtaatacagtgctatagcgtagcttaacattgtttaagtaatatggtttgcttatatttaagtcatttctaagggacccatgcaaacacagtcaggagatctatttctgatgtatttccaaggctaaaaacaaaaaatgctgttaatgcataaacagtcaaaaagctacgcattgtggttttacagggacttctatttctaaagatgatggttgcatgagggcctctgcctttataagggaaatgtgtagattttaactagctctgtattataatgtttgtgttttgaaaaagaaaagcatgtttctgcactaaaaaataaattcctaatcaaacctttaaagttaacatttagaacagggacagaaatttctattgtttcctaagtgttttgttgctgttgctgtttagatttaaatcattttttagaagttttactgaggcataattgatataaaaaattgtacacctttaatatattcacttggatgagtttggacatgtgtgcatacaccaataccatcatcacaaccaaggtactgaacatacttattcacctccaaaaattttcttttgttcttttttaatggtggtagtatatttttaagaattcagcctttgagcagggtatgaaggaccttcaacaacaaatgcaaaagtaaatgagctaagttcatataaagggttagctctcagtgagatattcaagttatgatcatatcctcaagaggcttgtaaactgactgtgggtttccagtttggttattcacagataggccttcatttgctcattcacctattcattcatatagccactcattcattctcaagaagaggtatttgtccatatctcaccatgtggatgagcagatggtcagttctcacttcttttgccattaagtgtgctcaccgttgagctccaggatggtattttctctcactttgcgtcattaccaaagtggctatcaagattccctcccctaccttctttttcttttttcaatgtttaagagctggagttaatttcttgactcctttggtaacacatgccgatatataccactcaaggcctgttggattaaactgttaaatttgtcatctagctaatgttttctcagaaccagacaaattaaacagagtcaattgttgaaattatttcaaaagataaacaatcatagaatggaaataaactacagaaagtagggaacaggagtaactaagtctcctagaaaacatttgcagcagatgttaagtatccagtctcgttgttataaatgaatttcaaagaatctcatgaggagcagctttacaaaattttactgcactaacaaatggcagccaacatctgtagtaaacacaaaatactgtaccatcctttgtatctccttaaattaagccaatttctgcttacacagaaaatctgtctgtggaaaacactgcttagaatttgaaagcacattaatctggaagccacaacagaagtgtgcttcagaaaacttcttaatgtttttcttgtgagttattctctttacgcttttcacattacaatattaccaagttatcataatgtattttctgcactcccagagcaagataagactctagttgttgctgggaactatacattgtctaaatatgggttcacattctctcacagtgattctggaatcatacacacaaatgagatcactgctgtcacatcactggaattaagacaacctctctactcactggccatgtaaatatagatacagtactcaaatcctctgaggcttagctaattattggttgatttggtctacacttaccacattaactatttgaaaagattcattgatataacatgtactaagaacagttcctgactcataatcattattaaggcaatatttaccaatatgtgacattaaaatagatactactattagataataattcatactatacattcaatatttaagcaacagaattataattttgtgaagtaaattttgtactcaaatagaaaatctaattctataattattttctgcaatattgggtcatagaaccaacaaagaatatgtgactagcttagacgtatgtatttacttatgtgattagtaataaaattcttcactcattcctaggtttgaatcccagatgctctgtgtagcagctgtatagtcttagacgagttgcttaatctgtctgtacctcgatttcctcatttgtactccaattttcttatgtggtaaatataaaattacttaactcagagctatgaggtcagttttatttgagagaatccagaaaaaaaaaaaacttaacacacatttcctaccattcggcatgcataatacgtactcaaggaaattttagatctctgtacatgattaatatattaaatcctcaaaccgactataaggtctgaaaatgcatgtctttatgtcactgtacctctcattgcacttggcacagtgttgtgaatatatttgtcatttgtatgttctttctaccatacaattctgccactccaattagcatattgtgttggaaaacaattgagtgcttgccttatgttttactaaatttatatggaactacgttgacacttccttgcccttaagatgctgggactcactggttgctttctagttctcaggagtctctatgtgactctgtcctttacacttgccctgcaacatcaccctcagccctagacaaagccaacatcatttttaaaaacctgcaaatatgtctgcaattcactgtatgaatattctcattctatcaaaaccctgacctcactaactcaatggagcaatataggatgataaagtagtttatatgaaagtcatagaaagtttgctttgtttattcacccaaaggtatgtttttaaaggatgaggcttttatctgaaacaaataaaattataatttgaaatttcaaataatgtgactaatagattatgaattcatttccaaatatagaaataattaaaatacttgggggtatagaaaaagtgagtgctgtatctattcttttattatattaattttaccctagctgccagaatttagtacttttaacatcaactgagagatttaaggctattgtaattttcctattttgattttcctcttctatttataactcaaagtaatttgataatatacactgtgatgtgtccccatgtatcaaacatttaaaaaatatatttggaaccaaagcaaagatacatattttttttaatttaattttttttttttttgagatgtcacccaggctggagcgcagtggtgcaatctctgctcactgcaagctccccctcctgggctcacgccattctcctgcctcagcctcccaagtagctgggactacaggcgcacgccgccatgcctggctaattttttgtatttttggtagagacggggtttcaccgtgttagccaggatggtttcaatctcctgaccttgtgatccgcccgcctcggcctcccaaagtgctgggattacaggcgtgagccaccgcgcctggcgcaaagatatgttttactaataccacagaggtataatctgctgctatttcttgatcagaagtaaacaagtgtcttcacagcagttgatctaattttcttccccattcattcaatggtattttttgattattatagaatatattgaattagataatgataagtcctttttctttttttttcagaaatggcttctctctgttactgaggctggattgcagtggcattatctcgactcactgcagcctctgcctcctgggctcaagaaatccttcgacctcagcctcccgagtagctgggactacaggtgagcaccaccatgtccacctatataatttttgtatttttttttttttttttttgtagagacagggtttcactgtgttgcctaggttggtctcaatctcctgggttcacaccatcctcctccctcatcatcccaaaattctgggattacaggtgtaagccactgcacccagctgagaaggctttttattataggttgttcttattgttttatttagttggttttcaaggtaagtttgacatataaggtggtataatgtttaaaggtcaagttatagagatagctagattgaagttcaaatccagagccaagttacttagactctctaaggacttgttttttcccttataaaattaaaataaagtggatagccacttcataggtttgtaataagaattaatatgatcatgatgtcacagagttgcaaagagatactgaaacttggctctgccaaaaaatattagctattgccattatgattgttctccttaatacctaaggcatttgctgacaatcaggttactcatcatgtccttccaggaaaaaaactttaagaatgttgaaaacttaggaactacttttaaaatttaattttcagacctgacataacacagctgaggaagagaggtggtagctgattggggatagatgtagagatcattaatggtataagagtgtgagaatgtgaagcaggataggatatgatattactcatacagatcacaaatacatgtcaaaattatatttatcattcatttaagtaaaattcaacattgttttcttcaaagaagaaattgcgcatttcactctacctatttaactctggaaaattttacaaactgagcatgccattttttagtatgaattcctttatttcagctgccctgctaactttgcatgatgagcagaaaaaaatgaaacagaatggttagttctggaatatgaaaaagtatccaagaagaggagtagtcttgagaagtagggaacaggatgaagtcactaggggacagaagggtaggagggagtgggaccagacaaacactgagctctgcatgcacacgtaacagtctaaaatagtcatccagcacgcagactctaggtcaagataaccaagatgaattgcaacttctccacaagcaacatgactttgggtaaggtatttaacttttctgagtcttagtttcttcaactgataaataaaaatgatggtcatatctacttcataaaattgtgataactgattaatacatgtaatgaatagtgtttggcatttagcttaataataagacatttcattaaaatattagctacttttgttagctagcaactctcaattttgcctaaagctgaccccatatctagggttaggttttgaaagaagttcatcaccatcagaactaggtctggaaattataaaggaaagcttaaaaaaaaaaccagaaatatgtgcaacacctatttacaaagaatccactgggaaacccccattgagcccaggtagatggcacatgtcccctttgggcatgtaactcagttccctgagggtcagtatattgtctttgtttcaaaggtcccaaggcaaactttttaataattgtgatcccactcaatagtcatgttcacttactttgtgggtacatttgtggcatattttaaaatgtgaagttgagtgcatttcacttaaaaaccaaaggcatgtaatgacaacatgctatagaggaaaaattattgatttgtgtaaataggcagatcttgtttgtattctagctccatcacttactaattttgtgatatgggcaatttatatcctatctgagcctgtgtttcctctacaatatgagataatttctactttgaagtactgttatgagggttaaatataaattactttctggtttatgatgttggtatatactatttccatgcatgatagttatttttatgaataagattttaacagtaagccatagaaaaatacaatgtaagactgattcttagaatctatcaaaacaggttgtaaaaatgacttaaacatctagcatggcagtgactaacattttgaaaagcttaatttttccattgagaactgtagcccaacacagtgtctgtgcctcagtgttcctcttatcaggaaggataatatctgtgatgcatggactaactctaatgaaaatttttattcttaagacacaagatatttcccagcacagtacataaggtctttgtgctcatgtcagcattggagataaatttctgggaaagaagtagagaaaccgctcatttctatagacatcaaaacaccaaagtaaaagtgaaaataaaggtacgctgcagacttttttttaaatgcctaaactaaaaagtatacctatcaggaaacatccaactcacaaattgctttaaatatgtttttaaaacagtgtgcttgttttataaccacagattcatgctatttatctgatattcccaggtggttgctttgtggggctcagtgccatccttggagcaataaaaagcatttcttctacaccagtaaaaaactggctacttctcacataaaccttggagggcttccctcagtgggcttagtgatcagcaaatcatgtcaaataacccttttggttatttttgacataatagtgttcctagcaggcagtactcaagaattcccagattcttagctttaaattcaatatactctcttgtattaaaagtcaagctatttatccacagtagttcttaggtccacgtttcattttacacatatatgtggatgtaacagctttttccttagaactttttaaaaaaatggaattcagtaaaagtcctatatttgtattttctatgtgccaagaacagataaccatcattaatgtgagccaaatttgaattgaggagctgaaattaggaggaattgaaaaacacctgaaataaatcttcaagtaatgaaggggaaagtttactttagaattagtgtatcaaaaatgagaaaattggctgggtgcagtggctcacgcctgtaatcccagctctttgggaggctgaggcatgtagatcacctgaggtcaggagtttgagacttgcctggccaacatggtgaaaccctgtctctactaaaaatacaaaaattagccgggcatgatggcacatgcctgtggtcccagctacccgggaggctgaggcaggagaattgcttgaaccacggaggcagaggttgcagtgagccgagatcacgccactgcactccaacctgggtgacagagtgagactccttaaaaataaataaataaataataaataaacaaataatttaaaaaagtcattgctttatttttaaaaaagtaatagtttcaaaatgtatacatgtaaaatctaactgggaatactttgtacctacttgtagcccaagattaagtttattctcaattactaggaggtttgcacaatagagtacatatttaatctgtatgactaaaagcctcattgtcaatgtgactgtgtcatcattatcacatttgtgaatctcctgattataactttcacagatggtctatctacagggttctgggataagaaacttgctgtctgtctacagaggaagctgttttcacttccagatagttctgaatatttgaaagtacttgctgattcagagtcaaattatgtcttgctgtaacatccacaatttctgaacttacatttgagataaaccaagattagactaaaccatgccttcaagtgacagactctcaaaaatgtgatgtattttttttcaaaaaaaactgcacgtccaggatactctacctggagaaaaacgtagctctcattaaccttgtccagacattaaacttataagagaaaatcattattttccttgtagccaaattattccgctaaattgtttttaggcaggattaataaacctttactgtaaagggaaagaggctaagatcttaggttttgtgggccatataatctctatacaactattcaactctgctgttgcagtgagaaagcatttatagacgatacacaaatgaatgagtgtgtccatgctgcaataaaactttatttacaaaaccagtctattggctggatatggcttgcaggccatactttgccaacccttggtttacagcctggctagctaaacactgcttgttgtagtaaaatcttgctttttaaaacatatgtctctcatcctagcattgtcattacatgtgtgtggtttattgttgaatatgtaatatttaaggatctttcctatttagttttattgactaaaagctgtttcataattataatacacagacatctatataggtttttattttatcattcaacctattagctaatccttagagttgtttcaattttcatgtgtttgacagatgaacatgtctaaaacactgatgaaaatgttaccagaatataaacaaaaatgaatttttccggttaaaaccattttacttgttagtaatatgtaactattaaccattaaataatttaccaaattattccattacgtaatccatattgctccttcttgtccacaagaatatagtaaggtacattatcaaatacatacctctgactttagtgggcatttaatgtattattagaggatcccaatatctgtctttcttaagaaaattaaactcatccctagtgattatacactttcttcatctaacactataatattaataacatttgaaaaaataatgtctaataattaacactagatttagagtatttttagacaattttctaaaattatctgaaaaatttgaccagaatcattgtaaaattcacatctgagcttatgaaagcccactttattccactctaaaagaacaaaattttgtacttttaattttatcttttaaaatgttttaacataaaggtagtgggagacgttactaaaggaagcttaggtagtaacgtatttgtcgtctcagttaacacaaagaccatagatggggcagatctgcaggatgcaaaaactttcctttttctcacctcatagtagtcatatggctactgcaattctctggtttcatgtgcttacaaaatgtcctttagttaaaaataaaaagaaagagaaagagaaagacaaagaaagaaaaagaaagagaaagaagaagaaaagagaaaaaataatttcttcatgtgtctatttaaattaacaaagacgtgaattgtcccagacctccctgtgatgattaatttcatgtgtcagttttactgggctaagggttgcccacatggctgataaaacattatttctgagtatgtctgtgtttccagagaaattagcatttgaataggtagactgagtgaagaggatcatcctcaccaatatctatgggcatccttcaatctcttcagagcccaaataaaacaaaaaggcagaggaagggtgaatttaatctgtcttcttgagctgggacatccatcttctcttatcctccaatattggaacacctggtctatgttggtaggagtgtaaattagttcatcataaccttgttggcactagggaccagtttcatggaagacagttttttcatggaccgtggtgtagggaagatggttttgggatgattcaagcacactacatttatttatttatttatattattattatttttgagatgaaatctcactcttgtcacccaggctggagtgcagtggcgcaatctaggctcactgcaatctccacctcccaggttcaagcaattctcctgcctcagcctcccaagtaactgggattacaggcacctgccaccacacctggctaagttttgtattttcagtagagatggggtttcaccacgttggctaggccggtctcaaactcctgacctcaggtgatccacctgccttggtcttccaaagtgctgggattacaagtgtgagcaaccatgcccggcacaggcacattacatttattgtgcactttatttctattattattacattgtaatatataataattatacacctcaccataatgtagaatcagtgggaaccctgagcttgtttttctgcaactagaggtcccatctgggaatgatgggagacagtgacagatgcacacactgcagggggattgcattagatcatcagacatcagattctcataaggagcgtgcagcctagacccttcacatgttcagttcacattaagattggtgctcctatgagaatctaataccaccattgatctgacagcaggcaaagctcaggcagtaatgcaagtgatggggaatagctgtaaattcagatcaagcttcgcttgcttactcactgctcctactgctgtgtggcccagttcctcaccaggccatggacctagtccatggcccacagggttggggaccccgatctaatgtgacaactctggaaatcagattctataccccctatttgttgttgctgttgttgctgctgttattgttgttcagtgtctaatgagctttctgaaataattttgtagtctgggactactcttcaacactcagccaggcagtttacatctctgccttagccttcacttcctgcttgcccagagcctcaaggccagtcagaggtgagagctttgagccttcccaggtctttactgaacatgtacgcaggcctacacttgggagtagcctcatagatttctaggaatcattctgttggaattttcaaagcccttatggacatctcattctcctgttttacttttaaagctttttagttagcctattgtctgcccaaaatgttatctacaacctcatacaggcaccaacttgaataacggcctttaaatgtttttgacaaatgccattaaggaaaaggctttttcgttaagtgagctcttaggacagaaaaagacatcctggcagtgggatgtttctgaaaaccaccagccaagtcaaatgacagttctctgggaatgaggctttgaaggaaatccagccccattctgtctttccagtggctgccaggctattggtcttcactgtaattatgggctgttaattttcaaggctgcagtggagccagcgaggagaggatgagaatagaatagggcaagttaaaaataccatactgcttgctgttcttaatgagatttttcattttatttatttgtgtgtgtgtatatatgtacacacatacacacacacacacacacacacacacacacacagtgaatggaaaataaatcttggggccccaaaatcactaagctaaagggaaaagtcaagctggaaaagggttagggcaaacctgcctccaattctattcaaagtcatccctccattcactgagataaatgcatatcggattgcctcctttggaaaggctaatcagaaactcagaagaatgccacttgtctctcacctacctgtgacctggcagccttctcactgcttgtgctgtcccacctttcttggcaaaaccaatgtatatcttccatatattgattgatgtctcatgtctccctaaaatgtataaaaccaagctgtgccctgactaccttgggcacgtgtcatcaggacctcctgaggctgtgtcacaggtgtgcctcctcaaccttggcaaaataaacttcctaaattaactgagacccttctcagatattcaaggctcacattttggcaaccatgaagggattctgggtggaggctcccctgacctttgacaaatctcctatcagtgctcggtaccagcttgaactatctttatggctcaaaccaatagaacaatttgccgagacaggcctggaagcaccccctccagagaatcactgatctttcaaaacttggtcaagatctaaagtttattttgcagtacaactccttttttttggagttttactatcttccaacgcaagaaaggcaagtttttcctgctttgatgacgatgaaatgcaggtaactcctttatggagtttgagcttgcttccaacggggaagacaaatgtgagtttcttccttcttctagtaagggaggagaccacccctcatatcgtcttatgcccaatttttgcctccaaagaaagaagtaaaaactaaaaggcagaaatgaaatccacaggcagacagcctggcgccgcaccctgggcttggtagttaaagatcgacccctgacctaatcggttatgttatctatagattacaggcattgtatagaaatgcactgtgaaaatccctatcctgttttgttccaatctaattactggtgcatgcagcccccagtcacataccccctgcttgctcaatcaatcatgaccctctcacacgcacctcttagagttgtgagcccttaaaagggacaagaattgctcacttggggagctcggctcttgagacaggagtcttgccgatgcccccggccaaataaaccccttccttctttaattcggtgtctgaggagttttgtctgcagctcgtcctgctacactaggatggtaaagagcagtcttcagcctgagacccatcccttacctaaggatgggtaactaaactgggggttgtcttggctaaagttaagattaacaaccagctggttgtaatttctctttaccattagagcactcagtagttggataagttgtgccatctttgttttgcttaattgtttttgttgttgttgtttgtttgtttctgtttttgttgttgtttcagtctttttgccattgggattgatcaactctatccgacttgatcaaatccaaaggaaacttccaaattatggggaacaagacctctgaagtggctaaatttccacactgtggtgggggagaaaaacagccaaaaaaggggaaaaaaaaaaacagggaagattttttactttgactacttaaggggctttatttacataacaaggccacctttttgctagccaggccaaactgaaagagcaatggctgtcactccatactgcagttccatagctaagggctctggcttctttttttccaccacgacagcttgggtgtggttcctaaatcaagccatttttggtttgatacttggtacttctgaaatagcagcaatttgttctagctgaattatggtaatgagattttaaaagatttttttaaaggagctcaatgattaaaagtcagcttaactaaaagctaacatccaagatgtgtgtgtgtatgtgtttgtgcatgtgtgtgtgtgtgtgtgtgtatgtgtgtgtgtttgtattgaaaaggccttcacatatttttttttttctcctaggaccttgtctctctttttttttttttagttaaagatttttttttctcagttgactgagttctgttttttgttttgttttgttttgttttatttacttctgctgcctctcctttctcttgcaccctctgctgcttgagggacctaaactattatagtttataatagcctggctttccttcaagaaagcagagaaggcaccagactcctttttggggagaaacctgtttttccttatgaaaccccaagagtgtaagcagataagttcatctcagctcttaaattgcctgcttttgtattgtgttacctgacttattgactaaaagagttgttgcaccaaagcctcctctggtttttaaggaagagtgtagtttacacattggaagtgtcttcgtttaaaaaaaaattttaagtgcactgaaaaagcatcacatggtctagcctcataataattctcccttttgggagattcaggattcagtgtgggctctgcccagagctcagagatctagtcaaaagacaggtatttcctacataaataaaattggtctcttcatataatcctatgacagatttctttttttttttttttctgagacagagttttcgctcttgttgcccaggctggagtgcagtggcgcagtttcggctcactgcaacctccacctcccgggttcaagtgattcttctgccttagtctcctgagtagctgggactacaggcgcccaccaccacacctggctaatttttgtatttttagtagagacggggtttcaccatgttgggcaggatggtcttgatctcctgaccccaagatccacctgcctcggcctcccaaagtgctgggattacaggcatgagccaccgtgcccggctatcctatgatagatatctgtaactttatgtttgatttggcatccctcttttgttttgttttgttttgtttgagacggaggctctctctgtcacccagcctggagtgcagtgacacaatctcggctcactgaaacctctgcctcccaggttcaagcgattctcccacctcagcctcccaagtagctggaattacaggcatatgccaccacacctggctaatttttgtatttttagtagaaacgggttttcaccatgttggccagggtggtctcgaactcctgacctcagatgatctgcccgcctcgacctcctaaagtgctgggattacaggtctgagccactgcccctggtgtagtacatggttttactgcatgtgactagtttacatgcaactagccatgcaagttcagtaacccaaggcggtctataccctgttcaacaagaaccatctactaatgacacttctggaagtctgggcaatgtcaacttgctgtaaaagttcccaaatgctctcaattatcatatgataacaaaggtctcaaatcagtaaattttgagtggccctttactaggaataatcttgaataagctagtactgccctccacaaccacaattaaaaatatatcggtattggttttctcttcagttcaagaatcatgtaaatatgtaatgtagaaaatgaggatttcccatattcccacagaatcacaaagatgatcactggtaatatgcgtgctacatatatgataccaggtttattctactctttttttttttttttttttttttgagacagagtctcactctgtcgctcaggctaaagtccagtgctacgatctcagctcactgcatcctctgcctcctaggttcaagcaactctcccacctcagcctcccaagtggccggaattacaggcacctgccaccatgcccacccagctaatttttttatatttttagtagagacgaggtttcactaagtagaccaagttggtcttgaactcctgacctctggtgatccacccacctcggcctcccaaaatgctgggattacaagcatgagccaccatgcctggccatttttttgtacttttatacaattatatgcttgctttataaaaatgaacttattctacatatatatgttattacattattaggacatgttcccaaatgacatattacattttcatcattcttttttaaaatattttttcgtgagacagtgtcttgctctgttgcccaggctggagtgcagtggcctaatcacaggtcactgcagcctgaaactcctgggttcaagggatcctcctctctcggcctcctgagtagcccagctaagtttaaaaaaaatttttttttggcctggcatggtggctcacgcccataatctcagcactttggaaggccaaggcgggcagatcacttggggtcaggagtttgagaccatcctggccaacatggtgaaacaccgtctctactaaaaatacaaaaattagctgggcgtggtggcaggtgcctgtaatcccagttacttgagaggctgaggcaggagaatcgtttgagcccaggaggcggagggtgcagtgagtcgagatcatgccactgcactctagcctgggtgacagagcaagaccctgtctcaaaaataaataaataaataattaaatatatatatatatatatatgtatatttggagagacaggtctcactatgttgcccaagctggttttgaactcctggactcaagcaatcttcccatctgggttcccaaagtgttgggattacaggtgtgagccaccatgcccagacattttcatcatcctttttttttgagacggagttttgctcttgttgcccaggctggagtgcaatgtcacgatcccggctcactgcaacatccacctcccaggttcaagtgactctcctgcctcagcctcctgagtagctgggattacaggcatgagccatcacgcccagctaattttgtatttttagaggacacagggtttctccactgtttttactagaccttgatcacatcaaaaagattgtgtctcttccatttattgtgcagcttgtacacaattgacacaatgaggagctcagcaaaggacgcagagtgacagcatcctcccttcagtggaatggccatgtctagacacctcttaatcactcccgagaagtagggatgggttcggtgtatgagaataagaaacggagcctccagggttgagacaatttgcccaaaacacacctcttgtgggaagtacagttgcgatcccccaggtctcttgggcttgcaggttcctgctctcccgtgggcccccaggagatgttggctgccaagaggaggaggaatcctcctgggcagaggttaacttttgccactccaggatttgcccaccctggggtccctgccaggaatgttcccccagcaccaccctccccatgccgcctcctaactggctgtgtccttcccaccattcagcaaacacatcctacgtccaggaccagccccttcatctcaggaaggctgccatgggactcccagaacccccatggctcctggagccctgagggaatcacatcttgggtggggagtgatttgttttctcatccagtgcaaccttggaggtaacagtcaagaatgtcctgtgatgcgaagcacttattgtcctgacctctggtccagtgcccttcgctctaagcacatagcatccccaggctgttcctggaggcgtgggctggggtttgtagggactagctggaccagctgggccaggggaggcagccatgcccggggcacatagccactgtccagagctgcccccagagctgggagccatcttgcacatggtgctgtgagatgccctccagagaggaagatggaagctgtctccgtgccccgggactgatgaagggcccattccaggcctttgggcacccgggctcgctacccttctgggagccctgtcctgtgggccaggacaaaggtgccctcactggtggcattctcagaagctcagccgctccccacacatgcacataggggcgtgcccacaccaagccacgtgtgggtgtctggggacaatgagtcttgggggagggggtgggtcccttccagaagggtctggccaaagtccagttatgaaggtgagctgagatgggctccctcaaaggagccatagtgtggggagccccgggcagagcccagagagaaatgccagccccgagaccgagacacgctccaaggagtgctgccaagagcagtagacacagccgctgaggcccacggggcacagtgaggctgtgggagagggtggcccctctgtggccatttccctgcctgtgctcacatcccctcctcaggcctgtctcaccagctcttgcagcccatgacccacattctgtctgactctccttcctctcctggctacagggatccccagtgcccctcaccattccttctggtctctcctctgcctcccggaactgttccccaggaccctctcctgggccagcccttcctgcccctccacatcagtggttccgaaccccggatgcctttgggatcagctgggtacactttaaatccttccagcccagagccctcaggcccaagtcacccccgccagctcctgtgggaccccttggatcagccaaccattttatcatcatccatcatgtcccctgtcaccaagggcctctggcatgttctgttgtccccatgcccaccctggcacccctcacccaccaacctgtgcccacgtcctgccttgagcctgtttcccctcctgagtggtatttcctcactccaggtgggcactggggcagctggcagacatggctgtgagcttctgtcccatccagagggaccctcccttccagattacccagtcaagcttgaccccatggtgtcaccgagacggaccaaaagagggtattgaagccacgcagtcccccgagccccactgagctgcaccagctttggagccggagagagcctgggagactgagcactgagtgctaggtcccttcttcccactcttgagggagaaatcagtgtaaccttcccatcctcccactcttgagggccctggggggacacagggcacaaggagggtggcagaagaggtgtgtgcctaggtgcttggcacctagccggggttcatttctgtcctctcaacttggcctcccaaagtgctgggattacaggcatgagatactgtacctggtcttattttttcttttcttaagatacagggtctcaccatctggcccaggctggactcaaactgctgagctcaagtaattcccccacctcagcctccgaagtagctaggactaaaggcatgaaaccaccatgcttggcttgtccaatttcattctacacactttctcggtatttaaacagctgctgttgctcttcattctgtagctctacatcagattcatgctctagtcctgtatatccaaatgatgactagaggctgccggctctgctctttcaaaggcacaatgagcgtagtccatctacaaaactctcccttttccaatccagctttccctcctgcatcacctatctctctacatctggaaccatcggcagctgccttcataaggcacctcggtctggcattcggaaaaccaccctgtcttgccagagcctcttggtcttgggtagcaaaagctgtatgcaatctaaatcaagctttcaatcatgagaaatcacattccttcttttccctttgtaatatactcatgtgttttttttttcctttctcaataagcaaattgtaccaccatcttattctgagatgctcctttttaaaagctgtagatcacattaatggaagtgtttactgctgggaatattttccacgtgcaatgatctgtaaccctctttttcttttttttttgagaccgagtctcgctctgttgcccaggccggagtgcagtgacacaatctctgctcactgcaagctttgcctcctgagttcatgccattctcctgcctcagcctcccaagtagctgggactacaggtgcccgccaccacgcccagctaattttttttttttgagatggagtctcgcttggtcgcccaggctggagtgcagtggtgcaatctcagctcattgcaagctccgcctcctgggttcacgccattctcctgcctcagcctcctgagtagctgggactacaggtgcccgccaccacacctggctaattttttttttttttttttttttgtatttttagcagagatggggtttcaccatgttagccaggatggtcttgatctcctgacctcgtgatccgcctgcctcggcctcccaaagtgctgggattacaggtgtgagccaccacgcccggccatgcccagctaattttttgtattttttagtagagatggggtttcatgatgttagccaggatggtctcgatctcctgacctggtgatcagtccgcctaggcctcccaaagtgctaggattacaggtgtgagccactgcgcccagcggaactgtaactctcttatctcaactagctgacattattacttcacatcctgttcaatttataaattaagagaggtgccatgggctgggcacggtttgttcactgttgtttgaatgacaaactcatctgcctttttaagaggccagtctttgatgaactttaaactttgtaaaactaatgcattgtgcctgtgtataaaccagtggttctccaaatgtgctgtgtggacctctcgggatcccgaagaccccttccagaaggcctaagaggtcataactgttctttttttttttttttgagaccaagttttactcttgttgcccaggctggagtgcaatggtgtgatctcggctcatggcaaccttcgcctcccaggttcaagtgattctcctaccccagcctcccaagtagcagggattacaggcacctgccaccactcctcgctaagttttgtatttttagtagagatgtggtttcaccatgttggccaggctggtcttgaactcctaacctcaggtgatccgcttgcctcggcctcccaaagtgctgggattacaggcctgagccactgtgcctggccaacactgttctgaatcatactaattaaacctgagaaagctgatgaaaaattttaaaaatttgtgaaagtaatacaaagtcattgcctgctttttcattgacacttgccatgattatataaaagcaaaagtgggtacaatggctggtttctcagcataaatcaaggcagtggtaccaattacattagtagtcattctattcttcactgtcccctacaggtaaaaaacatagcctgaatttcttaagaatgtctttgatgaagcagtaaaaattaatgttgttaaatcttgacatgtctctaatattctgaataagtggaaagttaaccagaagcgctttttttgtttgtttttaaagaatccgtgatttaactgtgaactgaaaaatcacttttttcacagaacatcatttttatttaaaagtacaactgggccagcgcagtggctcacgcctgtaaaatcccagcactttgagaggccaaagcaggcagatggcttgagctccttcaggagttcgagaccagcctaggcaacataacgaaaccctgtcactgtcaaacatataagaaaattagcctggcgtggtgccacacatctgtggtcccagctacaaaggagcctgaggtgagaggattgcttgagctgagatcatgccaatgcactccagccaagtgacagagtgaaactcggtctaaaaaaccagttcaactatcattctcaaaaataaatgaagtgagaggttgtcacttcaagggaaatacgtatttgttcccaatgataaaatttaagctttcctgtggactttgacaaacttgttccttctactgtaggcttggcagcttttcaatacttaaaggtgtgttaaagtaagattggtggttaaactgaaagtgatttttgacacaataaaacataaaccaatatattccaagtaactaatgcatgatattataaatgcaagtagtgagcaaaagatccatttactgtgcaagaaagatcaatgagtactgatggaataaatttattaatatgtaaaatgccaccgtaactaatttaagaaaccaccacttgtgaagttttgatttagtgttaacaaatacccacaactgtctgaaaactttaaaaatacaccttctaccaactacatatttgcatgaggttaggtcatcttattgcttctttttttctttttttgagacagagtctctctctgtcacccaggctggggtgcaatggcgagatctcggctcactgcaacctccacctcccaggctcaagcgattctcctgcctcagcctcccaagtaactgggactacaggcatgcaccaccacgcccagccattttttgtactttcagtagaggcgggttttaccatgttggtcgggctggtctcaaactcctgacctcaagtgatccacccacctcggcctcccaaaatgctgggattacaggtgtgaaccactgcgccccaccagcttattgcttttttgtttgtttgtttagacagagtcttgctctgtcacccaggctgcagtgcaatggcaccatctcagctctctgcaacctccgcctcccaagttcaagcggttctcctgcctcagcctccagaataggtgggactacaggtgcgtgccatcatgcccagccaagtttttgtaattttagtagagacggggcttcgctgtgttagccaggatggtctcgatctcctgaccttgtgatccgcccacctcagcctcccaaagtgctgggattacaggcgtgagccaccgtgcccaacctcttattgctgctttaaagcaaattgcaaagaaagctctagagaatccatttgtctcctattaagctcaacatgagagactttaaataatataaatacatgacgcactttttactcaactttttgttgtagaaaagttatttttcaatgaaaaaattctgttaacaatactgttctcaaggaatattttctgttgttataacctgggtcatgggttactactgatatctagttggtagaggccatgaatactgctaaactctctgcaatgcacaagacagtcctcacaacaaagcattatctagcccataatatcaacagtggtaaggctgtgaaatctaaactaaaaatagattttgaaaaaatttcaattgtataattctaccacactaaatatcaatataatcaatataaacacatactctttgagattctcaatcatttaagaattatgagactcttaaggaacaaagaaaatacaaataatttgcttcaatattttagtaggcacaatacagcttatgatgtctagagctgtgacctaacactgagcttgatatcttgcaaagtaattagctagaataacaagacaggtttctaaaaagctcacctttgtgtgatatgatgaggtatctccaaggtcacactgtggaaggaaaaaaaattcacaacaatagatgttaacatttgttaggcctgaagacattttttaaaaggggggcagaggaaactctcctagtggccctgaaattcaaatcttctagttcagaacagtaccataagggcactttgttttcatttctttgttttttacaaaaatatgagaaccaaaatgcaaggaaatatgccgttagaagacgcgtttctgttggtgattacaatatataaataataacagatttccttgttatatgcttttctacccacgaaacctttcgtcccatgcgatttattttatgtatttatttattttttgacccagagtctgtctctcttgctcagactggattgcagtggtgccatcttgactcctcacaacctccaccacccaggttcaagcgattctcatgcctcagcctcccaagaagctgggactacaagtttgtgccactatgcccagataatttttttttggaggggggcagtgggtggagtttcgctcttgttgcccaggctggagtgcaatggtgtgatctcggctcaccacaacctctgcctcccaggttcaagagattctcctgcctcagcctcccaagtggctgggattacaggcatgtgccaccacacccagctaattttgtagagtgaggctcaaaacaactgagggaaggcaaatctcaattctactaataggtctacacaatattagcactttttaaaaagcctgtaacattagcaggtaagatggatatgtctatggtgcttcaagtagttttcatctctgaaataattttaaaatcacagaatttaaagttacatgctggaaaggaccaatgaccttatgtgacatttaattcaacactcattttacagatcagggaaacagaccttaaaactgacttgcccaaggtcccaccaaataggagcagtttctcatcctaaactcaaattaagcagtggctctcaaactttgctgcacattaaaatcacctgagaagctttaatatctgcctcatcttccacgagacattttaatttaattagtattgggtatggctttgggcatcaaggttcttagtaaacgtttcccaggtgatttcaatcagcagcaaagtttggaatgattgagttggggtgaaaatcagaatcttctgggatgcttttcttcacagaaagatgcctcacatccatcccgattttcctaaaaggcttctcagtgcctagagatagagggaaagtggagatgggaagatacatgtgtttgcagacttgtattttgaaaaaaaccttgcataagtgatctcagcgagttccacctatcccactgacaacagtgcactactgattcatgataaaacatttttcaaaatatcttcttgaagccaatttgccctattaatttgttcaataactttatttcgccaatagtgaatacaccaaatgatcatttctcaaacttgctggtggcaaattaaaacttactatactctcaaaagtagacttctaaaaagtagaataatgaggaaaaaagcacgaaatttgtttcagcaaaattaatcttcaaagctgcttttgaattatatgctaacatatcaaaatctttggaactcagaagaagccagggactctagtcaaagtaatttttgtgtatgtgtgctcagagatttaagagacttagctgactacagacatttagtgattactcaataggtcccaaagctcaggacttgagacagagtttgagtccagtttttgttcgaaacacaatttcctctcaactattgttaaaagggagggaggaaagtgacattattatgagtgtaaactttccacttttaattgaagtaaaagttattgacaattgaattagttaaaaaggctagtgcatttgaaacaaaattgtttataagctagttatgtgtacagaatgaaaagttaaattaaagataaagacattaatattctaaattagcactttccaaactgtgttctaaaaatcaagactaataacccaaggagatgagaataatgtacactggacagcccctgtggagctggtggtggtgttggttgttgttccttttaaaataaacttcatctcagggtgctctcaaagcacatctttgtggcccatgaggtgctcatgcacaatgggagaaattcaaatgcagatacactgtggtgccagaagaagaaaagctgttccttcctccaaggataatgtccaaagtagtgcacactgatttaggcctatgatgcattgaaaaactaagtttccacaaaaaacattcaataaagggaacctatccttctcactgtgttcaacattgtctaaaggcataaaggcatcaaaaagatacactgtttctgggattgcttctttgctaactgatttttccttccaccacgacgtctaagattaaaagagaaactgatacttaatattcagaatctggatatcaatatatggttgactccaatttcttaaactgattgctgaaaaggacaaccaaatgactgaaataattttagaataaaggaatctgtccctcggcagcatagttgtactcatgatattattgtcattgtaagataatgctggatggctgtgctgtcatcaaggaatattgtcgaacacaagctgtattgttgactgaaacgcacagtagatacctgaaggggaagggaagtgtaagtcaaacttatgaaagtgtattattttctcagttaaaatgtcaaatgacaaagcactaagatatgtctcacactccatgaactgcctgagtgtggtatcatgtgcactctatagaaaacccattggaggctctcaacttccagagatgatgtttaagatatgggttataaaatgctgcccttaatatggtacctgtcatcaaacctaacaaggattttatgaattaccgttaaaaataatgggaaaagtctgcttcgaggggcgcggtggctcacacctgtaatcctagcactttgggaggtggaggcgggcagatcacgaggtcaagagatcgagaccatcctggctaacatggtgaaaccccgtctctactaaaaatacaaaaaattagccgggcgtggtagcaggcccctgtagtcccagctacttgagaggctgaaacaggagaatggggtgaacccaggaggcggagcttgcagtgagccgagttcgcgccactgcactccaggccggcagacaaagtgagactccgtctcaaaaaaaaaaaaaaaaagaaaagtttaaaataagatttcattttttttctgcagcaataaaaagcagctgagaatttctattaattaattaatttatttatttatttttgagacggagtctcgctctgtcgcccaggctggagtgcagtggcgcgatctcggctcactgcaagctccgcctcccgggttcacgccattctcctgactcagcctcctgagtagctgggactacaggcgcccaccaccatgcccggctaactttttgtatttttagtagagacggggtttcaccgtgttagccaggatggtctcgatctcctcacctcgcgatctgcctgcctcagcctcccaaagtactgggattacaggcgtgagccacggcgcccagcccttctattatttatttactacgataaaatgtaatgtattaaataatcctgctacaagagcattttattgcagtgaatacaagactaatgcatttactaaattactaatcctaaatgtattatttcaggtgatattgttacaaaagaagtgtttcagattcagaggctctgtgtgccagggctgctaggccaccaacaagtgaggaagccataggtttctctagtcctattttcttatgtggaggataaaaagagtatcacttaaatattctctcacaccctgaaaacaaatgacaacttaaaaaatctaactttcacttcatgtttaaataagactgccaagacatgactcaaatgagactctcggagaatactttgcattcacttcaaaacttgatcaattgcattctataaatcatctgacctgcacctagccattttcctgctctacccctgctctctgcctagaatactgcttttctctttccttgcttcagcaagctcgactccatctaccctcttggatctctttgtcggcagccacaccaaaaaatgtatttttatacactaattagttgaattcaccactgcttacaagatgctaattcctgcagagtattccccttgtgagaaagtatgcctctccataagagtaagggagggcccttactcttcctacctccagctgctgagcatagaattttgagtaaatccaaaacttcgacaagtgtttgacaattcagttatcatttggaaggtaagtcttactacatttaattacagcaaaaacactactaacagtttactctttataggtattatttaaggtagtcacaaaatagaaacaaatactctaacgtcaggcagcataaatgagagtatgaaattttacaatatttaacaagaaatggaaggggttacttagtagttttaaggtttaatgacaaaaactagaaaataatcgtacctagtaatttagtaagtcaaaaccaaagccttaccatcaaaggtgcagtacccattggatgcggatgcccacgcactgacttcttctgctgtacctgctgcctctcattttaacccattaaaaatactaaagttgttttccttgtagacatgtttcacctccttggttaggtctattcccaagtattttagtttagtttagtttagttttgcagctatcagaaaaggggttgagttcttggtttgattctaagcttggtcgcttctggggtataacagagctactgatttgtgtacattaattttgtctcctgaaactttgctgaattcatttatcagttctaggagctttttggaggagtctttagggtttcctaggtatatgatcatatcatcatcaaacagcaacagtttgacttcctctttactgatctgcatgccttttattgttttctcttgtgtgattgctctggctaggccttccagtagtatgttgaatacaagtggtgagagtgggcatccttgtcttgttccagttctcggggggaatgctttcaacttttccccctttcagtatcatgttggttgtgggtttgtcatagatggcttttattatattgagctgtgacccttgtatgctgattttgctgagggttttaatcataaaaggatgctgcattttgtcaaatgctttttctgcatctgtttagatgatcatgtgattttttgtttttaattctgtttatgtggtgtatcacatttattgacttgtgtatgttaatccatccctgcatccctggtatgaaacccatttgatcatggtggattatcttttttttttttttgagatggagtctcgctctgttgcccaggctggaatatgcagtgcggtgatcttggctcactgcaacctctgcctccgaggttcaagcgattctcctgcctcagccacctgagtagatgggattacaggtgagtgccaccacacccggctaacttttgtatttttagtagagatgggacttcaccatgttggccaggctggtctcgaactcctgacctcatgatctgtccgcctcagcctcccaaagtgctgggattacaggtgtgagccaccgtgcctggccggattattttttgatatgccgttgggaactacaaaacgttgctgaatgaagtcatggacacaaacaaatggaaagacaccccatgctcatgaatgggtagaatgaatattgtgaaaatgaccatactgccaaaagcaatctacaaattcaatgcaactcccatcaaaataccaccatccttcttcacagaactagaaaaaacaatcctgaaatttatatggaccaaacaagaactggcacagccaaaacaaaactaagcaaaaacaacaaatctggaggcatgacattacctgatttcaaactatactataaggccatagtcgccaaaatagcatggtactgatataaaaataggcacatacaccaatggaacagaatagagaacccagaaataaactcaaatacctatagccaactgattttcaacaaagccacctaaaacataaagtgaagaaggtaaaccctattcaacaaatggtgctgggataattggcaagccacatgcgggagaatgaaactggatcctcaactctcagcttacacaaaaatcaactcaagatggatcaaggacataaatctatgacctgaaaccataaaagttctagaagataacattggaaaaacccatctagacgctggcttaggcaaagacttcatgaccaagaacacaaaagcaaatgcaacagaaacaaataggtgagacttaactaaagagcttctgcacaggaaaaggaacaatcagcagagtatacagacaaccacagagtgggaggaaatcttcacagtctatacatctgacaaagggctattatccagaatctatgaggaactcaaacaaattacaattacaaaaatatggaaccagcccaaatgcccatcaatcaatgagtggataaagaaaccgtgatatacatacatatatatatatatgaggaataccacctcagccataataaggaataaattcatggcattcccagcaacctggatggaagtaagactattattctaagtgaaataactcagcatggaaaaccaaatatcatgttctctttcatacgtgggagctgagctatgaggatgcaaagccataagaatgatacaatggactttggggacttgggggaaaggctgggaggagggtgagggataaaagactacaaattgggttcagcggatactgctcaggtgatgggtgcacctaaatctcacaaatcatcactaaagaacttagtcatgtcaccaaatgccacctgttcccccagaaacctaaggaaataataaataaataaataaagtacagcatttttctcagcaaacataaaataaaacaaagactaaagttcatatttttcactctccttttgggcaggacaaattttagataggtttttaaagaattagtaacttttttcctttttccgagacagggtctccctttgttgcccaggctggagtgcagtggtgcaattatagttaactgcagcctcaaactcctgagctcaagcgatcctctgcctcagcctcctgagtaggtaatacgaaaggcgcatgccaccaggcctggctaattttttatttaacctttttgtagacatgaggtcttgctatgttgaccaggctaaaaatgaacaaatcttaattaacttaaatatttctaacactttgggcattcaggaaaacagctccatctatgttgtgaagtaatgggaagtatatggcagtggataaactttgaatgaaaatattaaacaaggccttaggagaaaagtgtaatatgcttattatagatacattaatttaaaaaattctctggcttaatataattaattatactcaaattagattttgatttaaacacaggtcctaaatttggattaaatataatagattgaccacaaatttatttcgtctccctccggaagcctcattagtcataaaataaaggttacacccatgaccagcacagaaggttgacagagataatttttaataaatgctgagacataaaaagtagataaaggagtggtaaataacacagaaacacaactttggtgcctacagaaagtgactggaacagaagcgagccagtttatcttgcagaactaaaggcaggttgtgaacttacaggcaaatggaactttggaaagtagggtaaaatgtgaaaaaaaaaaaaaagccagcaaggtcagttgcaaatctctaactagagccccaagtccacctgtccttccatctgacaagaaacttagatgtgtgttctctggatatatcaaacctgagaatttctggctcagagataccatggcttaaacctgagatataaagaaaactgtacaccaaaaatggaactccaactttcttcgctaactctgtttttcctttccaggcctgcttttactttccaggcagaaaattgggagatccttctcagaagaaactgaaatgtcttcaataaagatccccagataatacactgaggtctcccaaatgaaaagctagtcaggcttctaaggcctcacactgagtgctatcagttaacagaaatcctgcttccaaataaagcaggccagggaccaccacacattggagggaagcctccaagaaaagagatcaaaacaatagaaaaaaggaattgataggaccagtcaaaatcaggagcaaaactttaaaaaaaaatcttaaaacactctcaaaaaatataaaattcaatagaaatggtagaggataaagtcacagaatatcccagaactagaataaaaagacaaactgaaaaaaatacaaggggaaaaattaaaaatcaatgcaggcatattggtctaagcagcctagcatctgaataacaagactatcagtaaaaaagtaacagagaaaataaaaaaaaattctcaagaagagatagtctgcaggtttagtagcctcaataaaatgaaaagatccccaacaagctgttataaaatttcagaaccttagagagagagattctaaaaagcttccacagataactaaaacctggttgtaaataacgtatcacacactggcaatagattcaagaacaacactgtaataagagcacaactgcaaaatgtcttcagaaccacaacatttagattcaacctagaggtgtactctctatcaaagaggagggattttaacatctccacacaggaaaatgtgttcaagtacaactagagacgataacaggacagaaggaaacacagaatctaggactcaggtgatcccacacaagacagcagttacgtgagataccaaaagactttaaagagttagcccagaaaagcagacattgagcatatctagggaaacccacgctatattgaactaggatgacaaaaggccaaagaaagttgccccccacacaaacataaaaaggaacagatgtgttttcgcagatggaaaatatctttgaaaggcatgtgataaatgctacaatacttgggggaaaacagctgttagaaaacaggcaaatgaatatagtcagaaaattagcttcatgctaaaaaataatggatgtgaaagcaaacagagcacccagaggctacttaacgatatttggatagataaactaatgtaggctaggaaaaaagaagatccaggagaattgcagaagtgctcagatttcagaactgtttcagagacaggatgaaggacatggaatgcagaggcacagtgaaaacaccatatgacttagcagtgaataatatttgcagagtcataatcatgtaaatattactgatttaattaaaaagtgtgctacaattggaagaaacacagggagaaacataagatcatggtgtagcggggaaggtatgcttttacctgctgtgacagaaagtcaatagacagtgctggcaattaacttagctattctatttttgttctttcattaaaaataagattaaatatttaaggcaattttttttttttttttgagacagagtttcgctctgtcgcccaggctggagtgcaatggcgcgatcttggctcactgcaacctccgcctcctgggttcaagtgattctcctgcctcagcctcctgagtagctgagattacaggcatgcaccaccacgcccagctacttttgtatttttagtagatacagaatttcaccatgttggtcagggttgtctcaaactcctgacctcagatgatcagcctgcctcggcctcctaaagtgttgtgattacagacgttaaccaccatgcccagccttaaggcaggtcttttgaaccggactattgaaatttaacttaaatgtcagaaatctttaaaaggtggacacgctaaactaagcacttttctggataaatttaatactcaggaaaatagaagagatttagaaaatccacaaaaagaggtccatgctaccaccaccaggtccacattgtaatttaaagaaatcaagagagacatccttttatgtcaaactatcaatttcttaactatttgagtgtttacttacatggtttgtacagttgcttcttcttatttctacaactaagaataaaaaaaaaaaaactggtcacttctgatacaaataccataaaataaaagtagttgttaacatcttactgattactcctatgaaaaatgagacaaaattccattaaaaaaaaattttcaataacatataatttaaattatctggcatgattaatttcataagtcaaatctaaaaacttagattttcatttagtttactttttgtttctattacatacaaatgaaagaatcctcatgtacaaaagaaaagggcaaaaaaattaggccagatgaaaaatttagctaataaaaagtttaactgttgcatatatgagccatgatccattagtattctctcattctgcatttacacatagcttactttaattatcagactctaagagctaacagttctaaaaactacttcctgaccagacacctatctctagatgcaacagaatccctgtaagcatcttgaaccacacttagtggttatctactaatatgtcactaaaaacaaaacaaaattaaaaaatggtctttacacaactggaaagtaacctatcttaaatttgttttcttttttgagatggagtctcactctgtcacctaggctcgagtgcagtggcgggatctcagcgcactgcaacctctgcctcccaggttcaagaaattcttcagccttagcctctggactagctgggaccacaggcacgtgccaccatgcctagctaattgttttttgtatttttagtagagacagagttacactgtgttagccaggatggtcttgatctcctaacctcgtgatccacccacctcaacctcccaaagagttgggattacaggtgtaagccacagagcctggcctaaattttgatgttaaaataagtatacaaacctaattggacatggtgtctgcagcacaaaaaaatcatttttttttccctaaaaagaggccagaataataaaagccccaagagggacttgggccatgctttgtttcctacactgcctctgcctttgatgctgggagggccttgtaggcaaaagttactaccactgaagagtgagggacatggaatagcttttcttttactgcttccatgctctctaggtgtgagaagcccatggctctggaaggaactgggaaatacaattctgatatgttttggatatgttgcccctccaagtctcatgttaacatgtgacccttaatgttggagatagggcctagtgggaggcgtttgggtaatggcagtgattccttatgaatggcttggtcccatccccatggtaataagcaaattctcattacggtaatttaaaagactgtggtactggccaggtgcggtggctgaagcctgtaatcccagcactttgggaggctgaagcgggtagatcacttgaggtcaggagtttcagaccagcctggccaacatggtgaaaccctgtctctgccaaaaatacagaaattagccaggtgttatggtgcccacctatagtcccaactactcgggaggctgaggcaggagaattgcttgaacctgggagatggaggttgtagtgagccaagatcgtgccattgcactccagcctgggcaacagagtgaaactccatttcaaaaaaaaaaaaaaaaaaagagtgtggtaccttcccccttcccctctctctttcaccgtgtggaaccacctgcttcccctttgccttttatcatgattgtaagtttgctgaggccctcaccagaagcagatgttaaagccatgttggtacagcctgaaaatctttgagccaattaaacctctttttgttataaatcacccagccttaggtatctctttatagtaatgtaaaaaatgaagacaaattctaaccagaaataactgactcaagatgggcaaagtctactcaaactataaaaacaaaggttacaaactcccgtgttttactgtgctgcattacttcgcacactattatagaaccctcacttgtattcttgctgtttaagtcaactggaaaacttggctgtgtatggcttgttggcaaataaatgaggatttaacataacattaagggaaataagcaggagtagggcacgtttaaatttacattacatcgaatgaaaaagttaataacctaaaacttttgagtagcatgaacttggatgtggtaaatgaatgtggtcagaggactgtgtaagaggaggcccaaatcacagattcaatccctgatgataaacaactatgttttttaagttgtttaaatgaaaaccaagctgaagcctaagttctatcattcatctttaaagtgtactttttggagcaagggaaaagggattataaataaagataaatccattaattataaataaagataaatccaagaattataaagagaaatccatgactcctccatcacatcacaaattaattgtgttgataaaaagatggcaaaatgtataaacaaaaaggttacacattttcactaacatcataacaactaaaggaaagtatatcacatattaaaataagacaagtgaacatgtgaaaaggtgaaaaatttaaaccaatatgagtttttctaaatactttctataacctgatcaaacaagagattttattctttctcttggcggaaaaaacaatgtcgtctcaccatctgtttgagagttcctctggaatattgtgtttgcctctggattggcagaagggttaaactccaaagctatatgcatagaggaagaaaagaaaaaaagatgtaatcattgataaaaatttatcaactcatttattcgactgctgcatttaggctatttcactatctctactttgattcttatccattgaaatgaatgtatagacataagatagagccaggcaagatggcacatgcttgtagtcccagctactcaggaggctgagatgggaaaatcacttgaacccaggtcaggaagttgaggccagcatgagtaacacaatgacaccctcctttatttaaaaaaaaaaaaaaaaaaaaagaggtaaattttggctttgagttgtgtaaaatcaactttgcataaaataaatcaagatagcagtaagttttaaaagacagtctattttataggcaaaatataagatgtattctagagtttttaaaatgtttaaaaagtaaattcatcatatctgtcacttccatttcattctgaggacacagaaccttagttctcttgagtagctgtcttccatagtcatgtgatatctctaagttttcatttcttcattagcaatacatagggagaacatacacaggccttatttgtattggaaagggccaagtgagacatacataaactgtgttgtaatcctaaagaatgacaataaagagtcatttttgggctctcatccaacactacccatctactaactggtgtgtaacatccatcaggctttccgaacatcaccaagcagagtataagtttacacaagtacttacatgctttgtgtataaaggtacaatcaattaattcacataatgcatttgtttattctaaagcaatccttaaatatcttgaaatgtgaagatagtacttccaagttacaaagtcacactcataatgagtcttaattatcctacctctttaaaaattaagagcccgaccaaagtttaaatagaagagctataagacatttcctctacagtgatgaaatctctggcatttaaatgaaaccaataagccaactggatttaatatgtttatgatgcaatgttttctattttgaaaatttcagtttttattcaagaaccatattattacccagaattacttttacttagattcatctctttgcaaaattttagaggcaaaccaactaattgttttctcttttctaccggctcccatcccctgcctctgccagcagtgtagagactaaaaaactccaactttctttcctttttttttttgtgagacggagtctcgctctgtcacccaggctggagtgcattggcgtgatctctgctcactgcaacctccacctcctaggtccaagcaattctcctgcctcagccttgtgagtagctggaactacagtcatgcgccactacgcccagctaatttttgtattttcttttttagtagagacagtgtttcactatgttggccaggctggtctcgaactcctgacctcaggtgatccgcctgccacggcctcccaaagtgctgggattacaggcgtgagccaccaagcccagccaaaactgtaactttcttatctttgaacaagatgctattgtcaggaggggaagggacaaagggggagccatggcaacaaacactctaacagggaaggtctgccattttaacctgcaatctttatattacacattaaaagtctacattgacgtttcatgtcttttgaaagttttgaccatgaaccaatccccacctctcttttagaacaaggaggtaaataaagtctgttaagtcaccagaataaatctggagacacattttctgttaaagtaagaattttaaagtaatcagagcctcataggtaaactcctttgagaaaccccaaacacacacacacaaccatttttctgcagccccggctgtgacatttcacacctttcacaattattttaagcattctccttttttctttttccttctgtgttcaaattacagttagaagaaactaagcagcttctatcaaggtgacttaaagcagcccattaagaataccatatagcctctcccgtggcaacctccattctgattttaaataagaaatccccaaatatttgaataggaactgtcctgagatttggctactttaacaaaggaaacaattaggcacttacctggttccttcacttaggtaccatctggataggtacaaagaaaaaataagatgggtactgaaaagttgggatatttgagtttttattgagaaaaggaagagaatagctcaaagaagcctaaacaaagtcccacaggataataaacagagctacagacactgttgtctcaccatctgtttgagagttcctctggaatattgtgcttgcctctggattggcagaaaggttaaactccaaagctatatgtatagagggagaaaagaaaaaagatgtaatcatttataaaaatgtatcaactcatttattcaactgctgcttattcgacaagagccataaataaatggccccatgccagcctgggagaatgagatgagagagcaagaactgggcgattgggaggggaggcgaaaagaaactgactggactcggtggggaaagactaaggggtgggaattcaaggcagagccagcttttgttcctggccagcccccgggaaagctggctacaagcagaaaggagctcgaagtgggggatgcctcaaagggaaccttggggacagcagcagccaaaggcaaaccgagggtagatggcacctatcacctccttaccttcaggcatctcccggtcacgaacgtggtgcatgtggaggtcctcaccaacttcaacagtcacctcagcaggctgtacagcagcagccatgggcgctcctgccatcctgtcctcagctcctgcctcatagatctcagattcagagggacacaccgacccctgctgctggtcaaactcgaggctgacgctagggtgcacacgacaggtcagtatgttccccatggggcgcctctactgtctgccaccacctgtgcctctgctcacagctttggccacgcactcccgctgtcctaggccgaggctatgctgcacttgcagagatggtcttcccgctcctcgcctgcccacctcacagcgcggccccgggcaccagccctggccccggccccggccccggccccggctagggctgcgggccaaggcccgcaccctgctgcctcccctgagttgacttgtctgggagggtgaagaccagccggcttatttaataggttgtgaacccaacaagcgctgagagacacaacaactgcctgaaaagagaacagacggagctccttctccttctgtagtcacctacagactgaagcccactggccccaggtgggagcccaggcatgtggcacacaatgccccaccccacacttcacaatgccctccccgacacctcacagtgccccaccctgcctgccacccctccccaacagctcagaatgcccctgccttggctgccccaccctgtggcttatgatgctgctgctctcctggcccctcgtgcagtgccagtgggactaaggttttcattcatcaccagcttcctgagattttagtcctaagaaaagcacagggtagttcattccttgaagccagcttcctctatgagttctatacaaagcctcagtagagtgggtcccattagcaaccaagttgaacaacttttatttgctgtctgaatatagatacacctgaattgttgactgcttttgtaactaaacactcctctcctgtcttccaacgagtggtcatttttgtccgcaacttgaccacagcaatccctggggccctagctctactctcaataaagagttatggctgtgtgttttgaatgacaccttaggacccatcctgcctccacctccttctccataaaatagaaacctaactggcacctccaagctctgaaatgctgaaacttaccaactcccttttctccccgctatttcttccttccatggcagggactttcaggttttctttcttttactaacaaggcactaagcatgattttctcatacaaaatcgagagccataaagtggcttaccacagtcctatttcaataaagatgaatactcgacatctggcaagtagtgtgtgcctgacagtgtccccactgtgctatgctcatttaaccctcagaaacaatctcatgttacagattttacagaagttgttgagatggagaaggtaagtaacctccccaaggtcacatgactgctaagggtggggccatggtttgatcccaggtagtctgaattccccaattgcttaagcatgagtatcagaaagtatagcagtctgttttcacactgatataaagaaacacctgaggttgggtaatttttaaaggaaagaggtttaattgactcagtttcacatggctggggaggcctcaggaaacttaacaatcatggcagagggggaagtccttcaggaaacttacaatcatggcagaagggcaggtccgacttacatggtggccgcacagagagtgggaacatgtgaaggagcaactgtcaaacatgtataaaaccatcagatctcagctgggcacggtggctcacacttgtaaccctagtactttgggaggccaaggcaggtggatcaactgaggtcaggagtttgagaccagcctagctaatgtagtgaaatcctgtctctactaaaaatacaaaaattagctgggtgtggtggtgcatgcctgtaatcccagctactcaggaggctgaggcaggagaatcaatggaactcaagaggcagagactgcagtgagccaagatcatgccatggcactcctgcctggacaacagagcaagactccatcccaaaaaacaaaacaaaaccctataagatctcatgaggacttactgaatatcacaagaacagcatgaggataactgcccccatgatccaatcacctccccctaggcccctccctcgacacatcaggattatggggattataattcatgatgagatttgggtggggacatggcaaaaccatatcagaaagtaaaggtagaagtcaagcttggatgggaaatgacattgtagattattattattattattattattattattattattattattttgagacgaagttttgctcttgttgcccagtgaaattgtttctctaatttcattttcagattgtgtcttgtagatgtatagaaatacaattgataaatgattctggctattaaccttttatgcttcaaccttgctgaacactatttttttttttttttttttttttttttgagacggagtttcgttcttgttgcccaggctggagtgcaatggcgtgatcttggctcactgcaacctccgcctcccgggctcaagcggttctcctacctcagcctcccaagtagctgggattgcaggcatgcgtcaccatgcccggctaattttgtatttttagtagagacggggtttctccatgttggtcaggcccacctcagcctcccaaagtgctaggactacaggcatgagccatcgtgcccagccagattcgtatatttttaaaagaattttttttactttttattttttttttgagacagagtctcactctgttgcccaggcagtggcacaatcattgctcactgcaacctccacctcctgggtccaagtgattctcattcaagtgcctaagcctcccaagtagctgggattacaggatcccgcccccatgctcagctaatgtttgtatttttagtagagatggggtttcaccatgttgctcaggttgatctcgaactcctgacctcaggtgatccacctgccttggcctcccaaagtgctgggattgcaggcgtgagccaccactcccgaacagaacaacatttttttgatgtggattttaaaatgcctccccttctttcaacattgattaagtcccttctacatgccaggcactgtatgtgtgaaatagtcccaactctcaatgagtgtaggcagatacacaaacaaaggcttaaggaggtcagttttctgagaccatactgctggacagtatatgaacctgggatacaaacccacctctatttgacctcaaatttgatgctggggtggttttaattttattctgggaatttcagtcattcaaccataaaaaggtgaaaagtctctgtcagatgtgcgtgtagtggtctgtataataaagactgaaggaagcaaccaaaccaattaagagactttctctaaaggcagagtaatgctaagggcagtggcagtgacaaaagtggaggaaaaagtctgtgatcatttgggagacagaataggaagtgcttggtcatgagatgtgaaagaagaggggaagtagaaggaaaacagagctgctcaggctctgctggggaagactgggtgtgtagcagtgccttcctcctggccgagaatgtaggaagagaaataggtaaggaggaaaagatagttttttactctcagtgtcacattaaaatggaactctctggtcaaaagttgaatataaatctctgtaggctaagtccatttgtgacatcccaacatatgttttcaaaaataacatacacactaaatcaagccattaagcgtaactggggaaatttcctaaaatttacatgctaaaaaatcaccatttttcatttattactttcatggagcaactttgaatctatggttacagcaggtgaggcaccttgtataaaataaagctaatacatgaaataaaaccatttaaaattctattgttctcagagaatggagaaagcaattgaagccatgggtgtggaggtgactgccttgagaagttgtgtatagtaaggagaactgggaagaaagaagacctggagaatagggtgatttgcacggcattaagtgaagcttgaaaaagtgagcactgagactcaagagacatgtatgaatcagaaatggctgctcctgtgagttgttagaaaggagatgatgccttcttttcatatctataacagtagcacctagcacagtgcctgttcaataggtactcgacatgtattatcccaatgcagagtcaaattttgccaggaaggcaggaaagctacaaattagctatggcaacttagtgattgggcttgggtgtgtgtgtgagcgagctggatgtcaggcagtgggcaaagtagtgaactggaggtgagaaaacaatgacacaaactcagggcttctcttcccaagtatttggctgagaagagagatgtagtattaaagggagatatgtggtaaaggaagccttttatttcaagattcaacaaaagcgtgagtatacttctatgttaaagggaaagagccaatagagaaaacacatttttgaggttagaagagaaggaagaactaatgcagaagggccccaaaaggcacaggtgcgtgcaatccggatcagggacagattagctttggattcctacaaaagcaagaagggagaaaggaccatgtgacactagagatatttctggtaaaggaaaggtttaggaaaatatcttttgatgacctttattttaacataatttttttttttttttttttgagatggagtcttgctctgtcacccaggctggagtgcagtggcacgatctcggctcactgcaacctctgcctcctgggttcataccattctcctgcctcagcctcctgattagctgggactacaggcacccgttaccatgtccagctaattttttgtatttttagtaaagacggggtttcaacgtgttagccaggatggtctccatctcttgacttcgtgatccgccggcctcggcctcccaaagtctgggattacaggcgtgagccactgcacccggctagactttaaaaaaaaaaaaaaatactgtgggaaaaaggatattatgtatagaaaagtctacacttcttgatacaactaactaaaaaaagcctgatacactaaacaaaacccaaataatgtcttccctaaaagtgggtaacttgaaaagcaattcgagcaaaaatcaaggagttcaattataaataagtatatcaacaaagtgaaagatgggtttaatttttcccacaaaaagttaaaagaaataacagcagttttagaggaagaggaaaaaataataagaaaattatatgcagttgcaaaatgtgtgactatttacaaactctaacatataactacaaaacggaccagaagaatcattatcataggaagcaaagggtcatttcaaaaatcagaggagggatgattcatatttaatttaattctgtggaaaacatttaagtaacctttgaggacaaaaataggtgatatgttgaaatgcgggaaaccacagtggaaggaaaaagaattcaagaaagctcagtttcagtaaccagtatctagtaaaatcttcaggacctagaggctacaatctgcattaatagtgtctgaagacctagaaatgtcattaaataccattttggataattcttgtagacttgagatgatgtctatttaaagttacaagacagtgcctgtatttctgtattcataacagaaaacaattggatatggaaaagaaactaacatgctatgccacaatctctaaagaaagattagggaagtttcagcttaaagcaagaataatcacaataaagttttacaaccctttgcaagcatatatgaaaaacttacaaaaagtttgtaatgatcttttcttaagctaagagaatggaaaaaatgagaaaaattaaattataaaatgaaactttggtttagaggtaagaaacatttgatgacagtcaagagatcagggttgtacagtgtattatgtgaatgttgtgactcattggtttcatcttggatatcataacttgacattttgtaaaagtgatttttcatgggagttttttcaggtgccctataaagtcctgtcccatgagaagcgaataatagtcttccatattcttgagatatcttaatgaatagcatcttctacagtcttccattgtttagtccttggagagacactcattagtgactgttaaggtacctgagttattaggtgcctgtagactatgcccagtgatatgtgcattaggtacatgctccctagctgcgttgacactgactgaagctgtgaggtttcacaatgacatgtcagccaaatacatatgctcagatttaccatttatcaagaggtcttcacactatcaattgtgcaattatcattctacacacaggcagcgataaagggagtaaaaaaacacagccatggatcgggagactaaggtacctccagaggagtccagtgggtccagaagccctttggatgttggtcagaggctcctcttgggcagagatcacagcagcagccaacaggtctggtgaaatccttaagagttctcatggacaaagtttgtgaaggcatcttagacaagatcttgtctttgctggttttatgatcctctgcagatgggtctattctcattatctcagccacctttcacttcctatcagttcagttcaggtctctcatgatcccaggcagcagtagttgttatcacgtgagttcattcatatatgtttatctctttggggatggggggacaacttcactgtggacttaattctactggagatgagtgaccccattttaagacaacatgatcacaaattattatcacatatcagcagggcagacaatagctatgacctggggctgaaagcaggtaactccatttattctgcaaacattgtcttgattatggtgccagttgctgtgagggatttcctttccaccacctgtttttcacaaggtttgagtctgaactgctaacattctactgatttctgggtgaagggactgactgcaccatcctagcctgtcagagcattcgccccaatacttccactttaagagttttccaccttgtccagaactacagtccattaatcccctcattttctctcttaagagaataaacaggccaggcgcggtggctcacgcctgtaatcccagcactttgggaggctgaggcgggtggatcatctgaggtcaggagttcgagaccagcttcacttacatagtgaaacctcgtctccactaaaaaaaataatcacaaaaattagccgggcatggtggcaggcacctgtaatcccagctactcgggaggctgaggcaggagaatcccttgaactcgggaggcagaggttgcagtgagccaagactgtgccacagcactccagcctgggcgacagagtgagactccctctcaaaaaaaaaaaaaagagagagagcgagaataaacaacccatgtcaagtacacacccacatccctcttatcccaaataccaaacacacaaaaatccaatctgtctccttctacctaagcaattttagatagtcactttctcataattaccttaagctccctgacttgctgctcgtcctttctctggcaaaatctcatccttggatgagcccgactttgtgtttgctcaatgacaccactcacctgaaccagaaaaaatatcaaaaagtggtcagagatatcatcataaattcaaattacttacacaaaaaaattggccctaaatgtttccagaaatcaataaaagttttgtttctccaatgacatcatttcttcagaaacccaacgtgtataacctattttttctatgttcttctaacatttattcaacttctctcatctgatatcttgccaaatcattcaaagagaaaatatatcccattaggcaagagccgaccatattcccatcacctgagaaaatcatatgcacaggatgcacccacctcacctttctctgcctcatcatgtcagaaaaagtacccctccttttgccacaaggcaaatctgagataaaagatttagatggcctgtaattccagcacttggggagaccaatgcaggcagattatttgagtctaagagttcaaaagaagcctaagcaacttagggaaactgcatctctcaaacaaatacaaaccattagcctagcatggtggtgtggtggcacatgcctgtagtcccagctactcagggtggggagcactgaggtgggaggatcacctgagctggaaggttgtggctgcagtgagccgtgatcacgtcactgcactccagccagggtaacagatattttttaaaggatcttctctgttaaaaataatccaataaacaggtggccatgaggctgaggtggctgccgtgcactcaattcctccttaaataaaccaaaacttgactcagtgtaaataataaaaggaaacttaagcttaaccaatcagaaaccaccaactaacatctaactagagaccttccactgtaatgttccaaatgaggccactgctccacttcacccaatcaagtattttctttttcttccacattcaccatataaaattcttcccccaccctccctaagcctctctgtgggacctctgagctgcttgcagtctggggctgcctagtttatacatttctgaatgctcaaatatattttctaatgtttcaaagtggctctggtgtaggaggttgttggtggagtgacccgagagtatacaggaattgagggcatatgagatctctggactctgcactccattttgctgtacactcaaaactactctaaaataataatatatctttaaaaatctataactagcacgtagcccttttcaagcctccaactggttggagccagttcgattaaagctcagaagaaaaactggttaataagctagttctgacccaactggcaagaagcagcaggaaagacccaggccaggggagcatattgcacatgcatgcaccaggaaactggaggaagcttggaggccctttagcctggtcctgagcccgctgaaactgcagttacaggcacagatgcctggggcaccaatctgaatctgccaacatccaaggccacatgaacacaaatgcgcagtctcctctgcgatcggtagctaaggatgttaggccatgattggactaggatgggagatgaactgagaactctggattctgtaggttgttgttgtctcttcccacccccaagcaacaagtgatgaacacacacacacacacacacacacacacatcctgtagtgactaacaggatctccctccaggggatttgcagaaaggggagcagaaaacatcccaggggcctttcacagctacttccttgagccccctttcagactgctgtctagacctgtcgcagcccaaacatcatcaccctgatatgcagaagctggcatccttacctgaaattcaacaccaagaaatgatctcttctactcaacactgatagaaatacctctaagcaacgtcctcattggcaggggtggagtgggggagtttcttaaaaagggaggcctctgcctaccacctagagaacctggaaatttccatctgtgccacaaagtccaaatcactagccactgccccagtgtatggcagattagaacatctctccattagatctgggtttctattccattgagtgaaatggcttttctattacaggaacagaataagggttcaaaagggtcttacaactgaactccagtgtacagtctgcacagacactaggcttgtgcaaatatgacacagcgaggccccaggacccttaagccagctgaatgtactgagtttcaggaaacagtgagatacattcagcaaaacagtgggcttcatgctgaaagaagtcactccaagtaaacacacatcacacacacacacacacacacacacacacacacatacacacacccgcagacaccctagtggccaataggtcctctcaccaaaaacctgtgatcaggagagcagaaagcctcccaggggtccatcactgccctttctggagccccttatcagatggccagccccaggacagcactgtctgatcctggtccagtccaaaccgccatcaccctgtgatgtgggagctggccacttcaccagaacctctgtgtcagaaaaatttctcttccttttaaaatgatgagggggaaccttcagacagtgtctgattagggtgggtggagagaggggcttcctagaaagtcaggcagggcagggctgaagccctctgggttaactgtgtgcttttgatatgaagtcaggtaagactggacaggtgggcgtgttagtgaggggatggtgtagggtgtgctgaagaactccacttgagctctgcacaccagggaaaatgaccataaaacatcccatcttcactgctcagagaaggctagatctgctgtgagctagaaagccatgtgggggcagctgatgagtcatcaaatgggagaaatctgagagccatgtgttccacaggcctctggtccttgttcaggcagcagggcactgtgacatgtggctccttggccccttccagccaccaccttgattgcatgctgcagggaaagagactgaagaccaagaatggggtcttgctcaccatgggatgatggctcagtacagagctgagctatgtatggcccaagaggcagaatgtggggatgacccaggctgagctgggggatccaactgaacatgcacttgctaagaagctgtgggctatgatgccttgggaccccagtctgggtctagaattgtagcaaaacaggctactggtaaaagttcttgggaagccaactcacttttgctgtcatccatgggcaaacaaaccaagccccaccacttcccactccctctgaaagcctcctgcccctctgatcgaccacaccacaatggtgtcactctgtaaggcacaggtagacaaggcatccagccatgaacactccagggcgcacacatgtccagaatacactggttcttgttgagactccactcttccaactcagacagaagctccccaatctcctcagccactcccaacaactggaggtctgaaaactttcatgcatgccgctatggtctaaaccactcgtggcggttttcattttcattttcctgataatcagtgatgctgagcacctttccataatgccttttcaccaactggatgccttctatggctaaatgtctattcaaatccattgcccatttacaaatctgcttttttgtgggcttctttttttctctttttttttcctatttatttatacaagttccttaggtattttggatattttttaaaatgattttcaattccactgcccagttataattttttttttttttttttttttgagacggagttttgctgttattgcccaggctagagtgcaatggtgcgatcttggctcacagcaacctccacctcccagagtcaggcaattctcctgcctcagcctcctgagtagctgggattacaggcatgtgccaccatgcccggctaatttttgtatttttagtagagatgggttttttccatgttggtcaggctggtctcaaactcccagtctcaggtgatccatccacctcggcctcccaaagtgctgggattacaggcgtgagccactgtgcctggccaattatcccttttagtgtttttttggggggttgggggaagaacagagactcactctgtcacctaggctggagtgcactggtatgatctcggctcactgcagcctccgcctcccaggttccagcgattctccggactcagtctcccgggtagctaagatcatgggcacgcaacacatgcccagctaatttttgtatttttagtagagacagggtttcaccatgttggccaggctgttctcaaactcctgacctcaggtgatccgcccacctcggtctcccaaagtgttgggattacaggcgggagccaccactcccggccccattttgtgttttaacatcagtcgacactcgtattttaaaataacaacaatgaatggcggtaccttagaacaaaggaattatagatctttctcttgtcctagtgcagacattttgtctataaaatgttattcacagatgaattcatgagaacattactgtgaattttacatccatatacaagtgtatgctcattcatgaatatttcaataaaataaaactaatagcaaaaaagaattccagagttgaagcagtttcaggaaaaaggagttggcagtatgaagtaaaatagcaaaaaaaatgtttttttaaatgggtatatttgtgtctacaacttttttttaattatagcattagacaatgtgtatatatatacgtatataaagcaatggaagtagcattgttttcatactagtctagaatattaaaatatatgtaatatgtgatcagcaaaataatggccccccaaagatgtccacagattcctagaaccttacatgaaaacggtacatcatgcatgtgattcaggtaaagaccttgacatgaggagactaccctggtgctatggaatgaatgttgtgttccgtcaatgttcatgtgttaaaatcctaaccctcaaggtgatggtattaggaggttaagccttacgggagactctgccctcatgactgggattagtaccttattaaaggcacaagggagcttgtttgttcctctcaccatgcgaagacacagcaaggaggaagcctctatgagaaagcaggccttcaccagacaccaagactgccagcaccttgatcttgcacttctcagcctccaggactgtgagaaacaaagttctgttatttataagctacctggtctaatgcatttccttgtagcagcctgtacggattcggacagtgggctcatgtggatgatgacggtgtctccattcaggactaagtaagcacatgagtccttaacagtggaagagaagggggaaggaaagagccacagagacatgtggccatagaagaagggcccatgggatgcaaggttgctaatggtgagagtggagaagagcccaatgccaaaaaatgcaggcagactccagaatgtggaaaaggcgagaaaaaagatcccctagagcctctagagatgaaggtagcctttccaccacctagattttagcccagtgagatccacatcacactctgacatacaggagtgtaataaatttgttttatgccctgacatactggtagtttgttgtagcagcaatggactagtaatatataaatatatacacacacacacacacacacacacacacaaacactacccccccaccacacacaacataactatctatatatatcctgcccttcaaaactgaatcagataaactacacattagcattaacttagctgggtgtggtggcacatgcctgtagtcccagctacacaggacgctgagagggaggatcacttgagcccaggagtttaagatcagcctgggcaaacacactgaggccacatttcaaaaacaaacaaacaaaaaacacaacaaatctttgattaagctcatttcccaaatttgaagaggaaacaattattagataaagaggagaaaagagaaaggtagagctgctgacttctgtggtggaagcacagacacaggcccaaacatactcctgtcctcctggctttcctgtcccttctcataagggacacaggaacctctcaaactgaaccatggatcacagaaccatactcagaacgcaatacagttttgtctacaattttttatatatctgtgtccctgtctctgcctcccattcccaactcccttactcttgttagaaaaaaatggctattatcaaatatgagtacatccttatatactaatgccaactgatcaccagctggttttcttcttttacaaagtcataaatatttaggctttaacacatcttccaagcaatagaatgttattttccagttcattaacacaaattctatatctaaaatgaagacttcacaagttgatttaaataacatattaacgaaaatcgactggccatggttcaaactgacattttaattaaatgtgatgataggttgagcaacctagcagtactctaaaatgacttttggttatggctttttccatattatgtttaggctgaggcatccctaaatgattcaattgtaattccccttcttaaacatgagatttatctttacaaaataatttattttcttaaaattgcaagttaattctatagttcatgcatacataatctcagtagatatcagctgtatgtgtacacacatacatataggtatttgtatatacacacattacataattaaaaaaaaaacttattagcagggtacaaccacgaagacaaagaggctttgtgtaatgtgatggaaacacaattgcaggacaaacaacaggctgctgtgagggctgtatttaccctttctgatgtaagacttggaaaaacatggatactggatatttaatccccataacagaaaatttagggtgcagacaacttcccacaatttttacagacaatgtcaatagaaatgcattcaatgcagggaatacacagtgtgacagtatacaaaaataagcaggttgatggtttagatttatgagacaagagaaagaaatagtagatgatgtcataattctccttttatggagttatgaaagttcttcattttatataaggtcaggtgctttcaaatgtcaatgagaaaaatatttaaaggaagaatcaaatctaagatgtagagagatctttataaacgtgaacttcaggccaggcacggtggctcatacctgtaatcccagcattttgggaggcctaggtgggccgatcacgaggtcaggggatcaagaccatcctggcccacatggtgaaaccccgtatctactaaaatacaaaaaatcagccaggagtggtgacgtgtgcctgtagtcccagctactcaggaggctgaggcaggagaatcgcttgaacccaggaggcagaggttgcagtgagccgagatagcgctactgcactccagtctggtgacagagcaagactccatctcaaaaaaaaaaaacaactttttttcatgctgagaagatataatcatcaacacattcttgagcacaactatgcacacaggcacttccgcattcacaagccatgctgtgtgcacacactgatgcccctagattccttttttgaagagatggtctcttggtgtgtcacccaggctggagaggagtgttaggatcatagctcactgcagcctcaaactcctgggttcaagtgatcctcctacctcaggctcctgagtagcctgaactataggaatgagccaccatgcccagccaatgttttcattttattgtagagatgaaatcttgctatgttccccaggtgggtcttgaactcttggcctcaaggaatcctcctgccttgccctcccaacatgctgagattacaggtgtgaaccattgtgcccagccaccggattctttattaagaagaaaacttgtttgctgacatgtaggcaatgaattgatgaatagtagttcataaattactaatttacaagtcaatataaatgagttgagtaaacacaaaataacagcataaattaatgaacagtttacgacctcaagtttctttttttcctttaaaacattgctctgacagagactactacttgtccattccatggaaaagtcagaggtggttaaaatgtcagaggtacacttattaacaccttgctgccttttgtgtagcttcctctcagtacttcaccagttgggattgacacacctctccagctgggttcaggagccagacaggagcacacagaacagggaatccaaagccatctctgacaccaaaagcaatgaaaacaaaaataaccaaacatattatcaagaaatgaacaagagatcgatatcaagtacagcaaaaagagaagaaatcacttaatctgccaggctttcattctgacaaaataatttacaacacgcatgtctctatctgacatgtgtgaatagaaaaagaagaggtgacaatagagtagaggattcgtcttccaattgtctctgatctatccaacctttgttacacatcagagagttctccaatttataaataaacaacagagatatgtggcaaccaggacacagagacatactgagagtactgctcagctctctgcctaggcctgattctgatgatccctgacaatgagcactgtgaaatttacagcaaatcagtacacatacacacaaacacacaaaagagatacttcatgggcaaaaagcaccaaagatataaaataaaatgcctgaaagaccataaaacaacttctgatgaaatgctgttttcattttgcagtagtaaaatattcaccaccaaatctacaattagcttaaaaattacaataagtacagtacttttggatcccatctccaattcacaccttatcaacatgtaataatcacactgcatctacaacaaagctggatggactttatgtgctgaatacaacttgcacactaagaaggaaatttgttgaaataatgagaatccaaaatttgtatgccatgctctacttcacaagttaaaagaaaatacaatcatttctatttttaaaatgcattgaaataaaatacagaaaatacagtattctaataccagttaacattaagagaatatatctctaaaccaaagatcttggatcttctagaaacaaaatcagctggtatatatttggataagaaaaaaaaattaagagatcaagaaaggagagaagacgttcgcacagaatcatctccaaaaatggctttctgacgcattcgaccagttttcaagtctatttgtttttcctcctttggcatcaacagcctatatcaccaaggatatgcaaaataattcaatttgtacattaatcagctaatctagaagtggcaatatagtcaatgaaaatacaaagaaacagaaaatgtcaatgaattgcttaagatgtttaagatgacatagcgtagggaaaaaatgatctgataaacaccggaagagttaataaggaaactgaggcatggttccctaacaccacacttcaaaagaacttatagagagaataaaggaataacccttaaaaaaaaaaatctaattttagaaaaaaattgctcaaaagggaagttagggttttatagatcttctggaaagctgattaatttctaagctaaaaaaactatatgaagctttttaacgtagcacaatagataaaagtatgaaaacataaattagaaaaaactaaaaatcataccataagggatggataagttagaatacaggaataacaggccaggcatagtggctcacatatgtaatcccaggattttgggaggccaagtcgggaggattgcttgagcccaggagttcgagaccagcctaggcaacatagtgagaactcgtccctagaacagaacaaaaaaaattagccgggagtggcggtgcactcctgtagtcctagctacttgcggggctgaagcaggaggatcacttgagcctgggagttcaaggctgcagtgagccaagatcacgccactgcactccagcctgggagacaaagtgagaccttatctcaaaacaaaaacaaaaacaaaaacaaagaaaccacaataacaaaaaaacactggtaacaataaaatcatgattacataaagactgtatagaaaaaaaatcctcagaatatagaaataaaattacgtattttacctgtagctatattagaagagagtattcttgtagacaaggatgtctagaaggatacgcaaaaatgaaaacagctaataacactcattatgtcaggcactgtggtaggtagtttatgcacattgtaacaaattatatactacactatctcaaaattttcagataaattttactggaagtcataaatcaatacaacaaaatcagtgttttgcaaacatccactaagcataaaggtatacaaattcccaacccagactgaaaaataattcacataagccacacattagtggaaacctacccatgggagataatacaacataatctaaataaaactttcagagacaaggcatgtggcttctggacagccacaaactccctgactctgctctagtgtttcggccatcaaaagaaagccaagtggcctcaggtctctgaaaaaccaaaaaagcaacctatggaagatggcgtggtatttgaggaatatttgaagtctgttgaaaaatgcatcctgtatttttttcaagataagactcccttgtaatgtcaggtaagtgaagagccctcagagacacatgcacacacaaagaaaaacaaaacgacatagaatgaatcccaccaaaatgtgttatgatggcagaattatgggtgatatgatcttctgtaatatatctttttattaaaaatagaaaaaaagcagacttacccttgattatctatagcctctgacccaagtggtttggaattggaaagcagcatcactcgacttgaagccatcttggcatcaatggtggagtaggtggagatgagactctggaccagctcatgggtgagccccaccttgtcctatcaaggccaccaagaaagggcacgtgaggaaagcacaaagatcctggagagacactggtttcactcagtttctcaaaattatcttagacacatttcctgagaacctttcttaatgccgcaaacaccagagaagaaaatccttataacaaagcttgaaatggatccccatctccattaaacttttccaaagctcagtgagtatataacctgataacctaaacacctagctagaaaaacctcagttccagtgctacaacagtgctagcttttctaacatttttaagtaaccctgcttttaacccaataaaattcaactacagaactaagaaataaatattggaaatccactttaaaacaatgaggagaccactgtgattgagaaaaagaaaaagacaaacgagagctggaaagcacactgattttgtagaaacggaaataagccgtgcaggtgccacactggcagcagtgcccgcgctggggccacggatcaaggaggcatggaggacaggactcttctgcttggtacaatgaaaaaatggtattatttttattctacatattgacaatatgcatttgggcctttattataagtacaagagaaaaatcttcaataaataaaagctgagtacattactttttttgattaagaaatagattaggaaagaataatgagagttcagagcaaagactcctgcctcactgatgcctgaaaaccgtggctgccaccaaggtcaacacagacagcgtctttgtcatacagcacaccctcaactccagaaacaggcgcataaaccagctgctccttcttatttaaacagcacttcttttgttattcaggaagaacacaagggtctgggaggaaactgatgtcactcatggcaaaatgttctacccctggaagacaggacccaaaaagccagcttcaactgacaagaagtcagtaagtatctactgttgactggggggttaaaaacgatccacagtccaagggcttaacccatgaccctaaagaagggcattgtgccacactggaacagtgaccctctagctacaagaggtcagagaagagggattcggtaacacctttgcaggcctacacatagctggcttacttttaaaacctccagcaaggccatcttcccttgtttggtcatttttcacttttcctgagaaatgaagccatcccaagaatcctatgtgcaattctcgtatgttctacagcaagagaatacctggcatgtgaatttggcttttatttttcaagtgtgctcctcttaaataaccataaagtgacacctgcaggtcacatttgatgtttgtttggatatcctccgggtttgtcaaatcttccatcctagaaaaataaactcaatcatacagcagaaatgaatgccaaagttcctatacctcctttcatgtgtcaatgactcatcacactcttgtccattaagcacatcacttaggaactagaaaatgcagaaataaggaagcaccgttcaccatccagaagaggaaaaggggcaggcacacaactgtgtctctaggctgaaagtgacattcattccataagacaccagatgggagatggcgtccacctggggtcagggaagagtgaagaacacattcagaaaatccatttctcgaagagggtgagcctgtgctctgggatttgtactgtggcttggattctggcaggtggaaaaagggtattccaggctgagaaaatcacagcacaaagaagagcacaaaggaaggaaactgaaggcatgcacgaaggactccagcacccgggcacgaaggcagcatcactgaaaactgaggctgaacgtaggatggggccacatcctgtagtcttaaatgcttccaagtcctcccattttcctaaacatctcataattaatttactcccaaaggcacagcatctttgagcaatgatataagtagacattttccatcaactacacttctacccccactattcaaataggcacaaaataaatcctatcactgttctttttctagcctttttagctttgaaatatatggcccaggaagaaaaagtttacaatcaccttttaactgtctgccaggatataagggtgaaaagtttgccatgagaggcctaaacttcataactgtaataaaatggcccagattgtggatttcttggttttgatattctccatgcaccattccagaaaggtagaacagtttggcaacctaaacattaaaggaaaattaaaaattaaatttcaattaaattctcgtcaatactgcaacaaaataaaagctctaaacaagaagcaatcctaagaagggagacttccagcaaagccactgtcctgaggcttccagagccttgctggattctttcaggacttattagaaccacacagaggcagactgctctgcaaccaagccggggcatccatctaagtatggtgaggagagggaggtgaggcctctgagcacagaaacggttctgtggccgatggaccacagcagtatggaaaggaaggggcagtgcctggtcctgtaactgggagaaacttctgatgtactctattaagtcccgactccaaaacacccagacattgcctggtgcagcaggtacggagacaaatgagatacaccaagaggcccagaataaccactctcttgagggaaaccttccagagactgggaacacatacacaaagggaattcaggaggcaattcctagagagacgtttagtaatgtctcttcagtctttttgtttgtttgtttgtttgagatggagtctcactctgtcacccaggctggagtgcagtggtgcactctcagctcactccaccctctgcctcccagctttgagcaattctcacgtctcagcctccctaatagctgggattacagatgcatgccaccacacccgactaatttttgccttttgagtagagacagggtttggccatattgccctgagctcaaaactcctggcctcaagtgatccacctgactctgcctcccaaagtgctgggattacaggcgtgagccactgtgcctggcctctttagtctgtttttaaaggattatactgttagtttctaacaattatttctcttcctacctggtaaacttctgtccagaacctgtgttttaatcacttctttgtcttcttcagttgcttgttatgcttgaaggagtcgaggtgggtgagaactcccagaattttaggaaagccatgtgcttgacagatgtttagaaactcaaacatttccatttcaaacccaaagctggcatctataagcatcagtacctacaagcacaacacattatttctcgaagaaactaccaaaacagaccacctacactaggggttggcaactggcccacgggccaaatccagcccatcacctgtgtttgtaactaaagttttattggaacatagccacattaattcatttacatattgtctatggccgcctgtgcactacaactgcagagctaagtagctgcagaagatatgatccacaaagctgaaaatattcactatctggccctcaacagaaaagtcccactccagactaaatcaaatgactacacaggcatcacccagacagagaaaccaccaccctctgacttgctctaaaaggcaaccataagacaaggccactaggatataaacatccattttaagaattctaatgcatgagaagtaactcagaaaaggctgggtctaacctggcccttacctaagaaatcctaatttaaagaaatgaagttttctgtaatgtatttttaagccaaataacaggtctctgacatccaaagaatgggaagaaagtgataatcaatgaaatatattaaatacgtacagaaaaccaacctcttctttcaatctcctcacagaaaaaaaaaaaaaaaaaatctgtttttttgctgggaagtatacaatggaaacctctaacttgtatgttaatttgtataactcaattgctcagaaatatttgaaatagctaccagtttagaattaagtaaaaaaacagaaagattatgatgaatggtagtctataagaaaatataagcagataagaccaatttttttttttttttttttttttgagacagagtctcgctctgttgcccaggctggagtgcagtggcttgatctcggctcagcgcaagctccgccccccggattcatgccattcttctgcctcagcctcctgagtagctgggactacaggcacccaccaccacacccggctagtttttttgtatttttttagtagagacggggtttcacagtgttcaccaggatggtctcgatctcctgaccccgtgatctgcctgccttggcctccgaagtgctgggattacaggcgtgagccaccgcacctggccaagaccaatttttaaaatttaagacacttcaaagatgcaaaataatttcagaactgattcctggaaacttgtaattttaatattaaagatagttctgtttgtatctttccatggataactaaaaataacacaaaatggaaacagaaatgcccatccttgattaaactaggaaacattcaaaacccaaaaccacagaatatatgaagttgggcttgtaggaaagcacagctgccactgcagaccaaggcagcaagcagagctctccagcaacactggaccagctcaaagaacaggtggaatatcctcacaccacatctgatgccagagtgccaagggacaagcagctggttgtagggtcaggaataaaagggagcaaacagtccctcagctgccaatctttgccatctaagccagtgtcactcccctaatccacacacgcacgtacacacccaaatccacgtattgtgtgtgcctctgctgtactcaggaggctttgacaacccagagcagagcaatcaacataagctagactaaataaattatggtgcatccacagaatggaatgttatattaaaaagaaggaggcagagctacagtacttactgattatataccttcaagtatattacatgaaaagagcaaagcatagaacagtgtataaaataagctaccgtttgtgtttttaaagggtggcatgtgtgtttatatgtatctggaaggatatacatatacatatacatatatataaaggtctgcagggacctgagagaccagaggttacagcaaggaaagagaaaatgcgcattgtgtgtaccgtgcattacagttagagtgctttaccaaatgtgtgtgctccttttgaaaatcttaagatttacataggcatctctctcaatgatggttaagaggctgggaaggggagcagggagggagggacaaagagggaaaggttaacaggcacaaaaacacagttagatagaataaattctagtgtccaacagcacaatagggtgactataatttattatataattcagaataactaaaagaatgaaattaaaatgttcctaacacaaataaatgataaatgtttgaagtgacagatctctgaattaccctgatttgatcatcacacattgtatgcttctatcaaaatactacatgtaccccataaatatgtacaactattatgtatccataataactaaaaataaaaaaatgtaaatgcatctcttaatatgtatgtatttaaaattagaaacttgctacattttaaataaaagagaaacaaatgacttctatgaactattcaatcatttcaagtatacaagtttagtaatcgttacacaactttacattaattacacttatttttactaatagtagcattacatgttcaaaatttgaatgttatttagttttctgacattacaatggcacaactttaaaatctgtattactttttcctttatattttaggagtcttcctaggccaaagtataaaatctgtagctctagaaaaaactaaataaaaatgaaaaaaacaaggtatctgtcaccccacacttcctaatcaatatggcttatttttttgctaattttttttttttttgagacagaatttcactcttgttgcccaggctagagtgcaatggcgtgatctcgcctcaccgcaacctccatctcctgggttgaagcgattctcctgcctcagcctcctaagtaactgggattacaggcatgcaccacctcacccggctaattttgtatttttagtagagacggggtttctgcatgttggtcaggctggtctcaaactcccgacctcaggtgattcgcccactacggtctcccaaagtgctgggattacaggcatgagccactgtgcctggcctttttttttttttttttttttgccaatgtaaaagatagttcatagaatatcagaaatagtgaacattatcatttccataaatgcaagagcatgtacattttccacacgctgagtactgcctgaattttctattgataaactctgaccacttcttcaggcaattcatgtacttactttagcattatcattaaggatgaaggttctagaaccatcaggaacaagggtcccatcttcacacaagttacttaactgctgggaggctctatttcatcttatgtaaactatagataatacctactcacctcaagggtgtatgtaagctaaatttgtagaaagcagttagcacagtgccaggaagggtccaagaagaaatggtacttactatgatatatttgtacatatatatgtatgcatgtaaatgagctcttattagctgtgttcattaaaggttttctccgtcctgtgatctgcttttagattttggaacacatttcattgtgcacattccatttgtattattaatatgacaacatttattactattattattatcatcatcaattcaatcacatctactatatccctgataatgaccatgatccttttaataatcacaaaactctcttcccttcatcacggggtaaataacctatcacaatgctgtaagtctccatcagcaccccaggctgcccctgctcacttaccagatctgctactttagccagatcaatcatcatgttaatgtcacacccacattcaataatggtgagtctgcgctttttacctataagtgaaaagatgaaaattttactttaaaaagaccctgaaaaaactctaaccatcaactcttaattttcattttttaactgcatccagtaaaacaccacatacgtttacaggagtgtaccagaagttcatttttataggcaaaaactggtaaaataaattccatcctgtttttcttcctgtgttctaaatttagataatatcaaaagcctacccagatgaataaaagtgctcaaaacagggaaaattctgactagacaggctccacgataaccatgatcttgctgttcagctgcaggccaatgtcttcacctctatcaaaatttcctgtattcccactatcgctaaaaacatcctcaaacataatgcaacagaatatttacaatgataattatttctaaattaaggtaataagaaaatgatcaagaaaatattggctgggcacagtggctcatgcctgtagtcctggcaccttgggagaccagggcaggtggatcccttgagcccaggagttttgagactagcctgggccacatggggaaatcccatctctacaaaaacataaaaattaaaaaaaaggaaaaaaaagaaaaattagccaggcatggtggcatacactactcacaggaggctaaggtaggaggattgcttgagcctgggaggttgaggctgcagtgagctgtaatcacaccactgcattccagcctgtgccacagagcaagactctgtctcaaaaaaaggaaaataaaatatggatgcgccaaagataaagaaaagcctcaatccaactatattactgcaataataagagatttcagagtgtacattgccattctaccactggatgtttgtttcatcttccctcaaacttggaaaggtcaccatctcccaaagcagacaaattctcataggaaaaagagaaaacgcgcacttccaccagcatgtggcttcataagggcaagcatgtgcacctggcacataggaggtacgtgctgtctgttaaatggtgtgttcgcagtgaccaggcctgtcaggcccttccaaggaacatgcttggcaaagccatagagcagtcaggataaggtatgtatcacatccttatctctgggaacttatccttttatgaagttatagctaacttagtaaaagtaagagagaggtaacatgatatgacaatatttaacatgttccactcaagaaaacaacaaacacacgcatgtccctcagatgacaacagccacgccaagtctgtgtctgtggcggcatctcctacctgacacgatcgtcacagggcctctgatctcggtgaacttctgccaggtgaagttccgaatgaggcattatatcaaagtgctctttccaactttggaggccccgtcaccactaccgctattggtggcggctctagtggagttccatcaaccactggaatatgatgcttttgtgtcttcaaatccagagtcctatttatttaaaaaagaaaaaaaaagtaaactcacttttaaaatagagtaaaaggtatcaaccttataagtagacttttttttagtataattacagatatgagtactttagtatattttatagagagtacaacagacaatataaaaatataagtaacttgtcaattattaacttctgacccctatccaaatcaattgctgttcaataaagatgtaacaagatgacttcaatagtatagagttgaaaattaaacactccttaaatctgactgttttatgagtgatttttatagttttttaaaaaccaaaaggtaaatactgaggcagcgcatcataacagataagagcagaggttctggagttaaatttggctctccgacttactggttgtatgattggaggtaacttgttttcttgacctcagttttcttgtccataaaatgagggcaagaatgattcctactctggtaaggctgctggaaggatttagttgaataacgtttaaagtacactgctaagaatatcataaggactcactaaataaaactatgttagtattacatattgtaatttttgtattttatattacaactttgtaaaacatatccagagggaaaaagcacacttatcaccatagaaacagtttaaagtttaggaagaatcaaattctataaattcttgtatcttgggcaagaaacaccaaccagtgtgcagatgctggaggcaaggcagcttctatggcaagtcttctcacgttttagtaaaagccacacagcatgcatctccatgtcctttggagctggactagacttgtgaatccaaatgtcacctgtgagaggctcctaactatttaaaaagattcaatggaagaaccatcagactgtagctaaacacacctgtgaaaggatcgagacatccacacagcagactgaactgcaaaagcattggcatttctcttctgggcattttcttcgtctcctagctggagatcctgcagatgccacttctttttctttgcagctttgggtccactgtttttctttctgtgtttcttctggtccttagtctccatagtggctatttaccaataacaagtaactctaacctacaaggaagaaggttggggtaaggaggtgggagaagcattttacaatccaggcaatacccagggaaaaacattaaatttcatttatttctttatgaagacatgatgtatttgttcactgaacaagggtagaaactgcttaaccatccccaatttcatttctctctgttatgctataaattagatgagttacctctgctaaggttacattctatggttaagttactttttactcgtctcaagtgtcaacatcaccagtacctatttctgcaaggatggaaatattctatatctgtacttttcagccatttagccattagccacatgtggttacttaaaatgtacttcagagaaactgaaaaaatgaattcttaattaatttcattctaactctaaatagtcacatgtggctaccatactggacagctcagacctagacatcgactggactaacgaagtggtttcctaacttaaactaaaacttaaatttcaataaaaaatttaaaacgtttttatgaacttccaataggatcgcagtattacttttagtacctgttgactctaaaacttctaaattacagctcatctacatacatttgaaaaatagcaatatctgtatgtgtgagatatgactggttctagatgatgcctggaggccccatggacttacagagacccttccagtgatttctgaggtacctgggaatctgtggccaataaattggtagtcactgaatctgtgagtttttttggaatatcgggctgcataaaatctgacagcttgattgagaaaaagcggggcagggtgccatttcattcagttaaggtcctgtattcattccgtttaataaacgtttgtgtctgtctatgatgtgctagccactgtgccagaaaatggatatagctatggtctgattgacagaggaaatccaaactagtatcttccgtgccatgcaataagagctacattgcaaggctgcagagggtgctactggagcacagaagtgagtcaaaggcttcccacagacacacacacgagcggaaacagaaagtctttatatatcaccatatgtcaaggaacactggccgggagttaggagagctgggcactaggaacgctttgaaactgaatagctgtgtgatttcagaggttatattgcttgtctactatattttactgccgaacttgtactgtttctctcccttttcttcttggtgggaaaagcacaatttggggtcaacagattcggctcaggtctaagtcgcctgccgggaccacgtcgccaggaaacgacgtctccccgacaccttccctcccagtccgggctctctgcagggattcatcccgtcactctcccaacgaccctcgggcacacctcaggcagatgcgaaatatgccgctcctggggagcaaagatgacccggaggaccgggggagtaccttcccacgcgcacgactcgcgatcttcccagtgccccagagccacggacccaaccgccgcctaccccagcccgcggcacctaacctgttcacaactgcgactccttaggtccgcttggacaccgccggaaacggaaattcaccctcgcgccgactcgccggaggtaaacaaaaaggcagaaaaaaagggaccgccgcctggacgacttgcaggggacagctggaagaaagactcgtcaacggccgagtgctggcgccggcgccgtctgcgcagtgcgttccaccgggtccgcgtccctcccgattcagccccaccccgccctcggaatccgctgcctcagctcctgctgtggcactccccagcagcttgcacctcgctcgcggagtccttgctgaaggccagggcagctgtgcggcctggcgcgggttacttgatgccgtgcaaaagccaggagacacatttggttctggccgccccggagtcaccgtgcccggggcgaatggactatggctggattgggagaccacttcctcctctgtaaagatgacagacgagggagatctcacgttctgggggtgccctatagccctcttttggccagaagcggtggatcacgcctgtaatcccagccctttgggaggccgaggtaggaggattgcttgagcccaggagttcaagaccaatctgggcaacatagggaggctacgtctctcaaaaaataaataaatacataaataaataaaaataaagccagcgtcgtggcggggcgcctgtggtccctgtggtcccagctactctggaggctgaggcgggacgatcgcttgagcctgggaggcagaagttgtagtgagctgagatcgagccactgcactccagcctgggcgacagagcaagacactgtctcaaagaaaaataaataaataaaataaggccctctttttccgggaccaacagactctgagggcagggacaaactgacccagcctaaactgcctcgccttccctgctcccgggaaaggggttttccctgagggaaggtagcatcttgccattttcttcctgcacagctttgccttcccagggatccacccattgccacctgaggaaatgccttggagcccatctaatccccagcccagctacttgggacgcctacagagactacattgtcagaggatgcatcttcctctagtcttggagggtttcttttcaatatgatcccaccggtgcatgcaaggctcaattctacatcaaaaaactaggcccactcctgtcgccgagacccccaggcttcaggtcctgtcacagtgaccttgttatcacccccagcagcccccaggtattcactctgcataggctatatactgggtgctgcactagggaggctacctacgtggcgcatgcttcccttatccctgaagagcttaggatgttgtaacttcttcacactaggcctcttacttcttggagatgtcagtatctgggtaaataatccttctaacatccttttggtcttatgaagcccattcttgtcctctgccctacctcagcttccccctccctccatgatcagaccttagaccttgtcaggtccaaggactgcaaccctcacagtatcccactctgaccaccacctcctatctagagcaatggagagactttgtaggtgaaagctgtctttgctactggttctcctatgctccctcgcctggctcctgcaggcggttgacttcaccagggacacagtggccagtgcccagcaggtcccactcctctcaccagctccaggcagttttattgtagagtaactcttctgagacaccgctcctttccccagcacctaaggaagtatttctagtaagttccagtggtatagcatcggtgactctcccgacaagcagagggccatggctgggttcctctgatgaggtgcaggggcagggcactaagaggggaggactctcctgagttctctacctgagccctagactagtagctgctcctcctatacttcctactagtctgtgcctggttactccacttccctgttgcaattaacaattccctatgtacacttttcctgttcaaatgactgtgtggcttctctttcctaatcggactctgaccaatacgctatcatttgccaacaactcccaaagttttatcagtgactcagacctctaacctgaactccagctgcctccatgagatatccatttggatgtttaatggacatttccaaagtgatatgccctacagaactcagaatcttccctctcaaaccaactgctcagcagtcttatgatcttagttgatggcaattcagaagtgaattgcaggacacccggtttgtatctgcagagagaactggagaactgcttagtgtggaaaacccacacatttggtttcagaagtgtgtgagtagaaacagttttccttttatgtttgttggatggataatgatgaacctagcaggacacagaaagctaggcagcagtggaactgagaatgaagttatagttaatagcagagaatgaaaaagaaaagacagataaaacattttgaagaaaggacagtaatgtattcccaacaggtaggatttacaggatggagagaagaggcaaagataactacaaaatttctagcctgagagactggtagaaaaaaatggtggtatcaggaacagacaggggttattaagaaaaaggattggatttttaaaataaagaagatctggtgtaaaattatcctcaggaaaactggaaaactaggcatgtacttctctccatcatgcccttgcacagtgcagtccttctgcctgtccatgcctcgcctccccctccctaggattcctcttcctctcttaagacccatctcaaatatcacctagacttgtaagtaatttacatgaaactggatacctgaggtatccctttgaaagtttttaataacaagttactgttatcttttactaagtccaactttatattcgccattttaactagcatcatttctgtttccaagaggtatttggtgtgaaagtgcaactaagtttactgttaatcaagatcagaataaaagaatctaccaaaaaaattaacaagatcccccttttaatgcataatctttcatccatcaggctgtaagttaaatacctaacataaaagaaagctgtatgttttatggatatgtacatatataactgcagggaatatgatttggaaggatgtacacttagagaagactggagtcacaagtggtagtcaagggagtcttcagatttctttttgtatttcaattttgagagaaatacatacatatgtattataattttaaatttttaatgaaaaaaagtatttttccttttttttcttgatctgtcactacattatatttttccaatatcagctaaacatttgcttcccagaaagcttagttgtcttttcaaaatttattcaggttaaaataaaagatttagacaatgaattaaaaatctaagatggtatttgcctactttatacagaacagtacattgatgctgctaaagcaattaaagtataatttttctttttttttttttttttttttttgagatggagtctcactctgtcacccaggctgaagtgcagtggtgcaatctcagctcattgcaacctctgtctcctgggttcaagcaattctcctgcctcagcctccccagtagctgggatttcaggcgtgcaccaccacgcccagctaatttttttgtatgtttagtagagacagggtttcaccatgttggccaggctggtctcgaactcctgacctcaaatgatctgcccgcctcagcctcccaaagtgctgggattacaggcatgagccaccacacccagcctaaagtgtgtactttttcttagctcctatatgcagtgctccttccccatactgaatgtctgaatttttatctgagacatagtatttcagatggtcattacttacgggtggtcattaatagttcctccctgcttctaaccttcctctcctcattttaaattaaattacgctacattattgtggattagaaagtacattaatattaagtgaaaaaatatgatctgatgagtaagtggcaagagtgttaacgtatgaatattaagagttgttctgaggcctttttgcttttctgggggttctgtgcttgtggtagaactcttggttattttataaatagttcctgaaaagtgagagagtacagctggaaatcagatttctgatgaataaatcaaaccctattaagagaaacaggttcaagtaattttaaaaccatttgaattttcataaatgttttgttaatgattaattataaaaaaaaacagtgactctagctggaggcttttgtgtgtttgcttttgagtcagctaggaaaaggaagaaaaattcaagcttagtcaattgtggttttcactgaatcttttttaaagtaatgagctggtttgttttcttcatcactatagcaacttaagctagtttttgcttttgatttttatttctcctagagaaacttagcatgcactgctcattagacttgggcatactaaggaatatctgtggtaattaagttaaaaatcagatcagtgctttgtgctgtgtatagttgcagatgtctgcatttcactaatattctttggaaacatctggataccagttaacataaaataactgtttagttggtttctgttcagaatagaaggaatgacttaaaagttcccattgtagtacatacgtcattctatccctagcccttcctccagctttactgagattgataaataataaacatcatgggtggtgtgtctttagtttcctctggtgagctggatgcacagattactttgtcagcagggtggtcttgatttttaggccatgtgtctaatggcatcagctctgtggccgacacctgtgtaccaagcccattcactatctagcttagccagccgtggactcctgctctttgttaaaagtatttaccttcattcctactagcacagttgaccaaagacccagttgatcccaaacactagtaatgcatcaatggagtctaacagagttttaagatgtgtgtgtgtgtttgggggtggggggtgtagagatgggatctcactattgttgtccaggctggtcttgcacacctgagctcaagttctcctgcctcagcctcccaatgtgctaggactacaggcatgagccaccatgcctaaccctctaagactttgggatacaaaaacataatttactttccttcatttctggaataaaacatctcttcttcctccccctactttctgttctgtgcccctgtttgatctctgttggtcctgttcaccttcagccttctctgctgaaggaggaaaggcttggttttataaaaagtgacaatattcagaccacataagatccttcttgcttcattttggattaaatattttaagattttctgattttcttgtatgcatatgtatttacctattatttgactttattgaataacttcaaattgagtatatttgaatgggaatgggcattaaaaagtgctaagctttccctgcctttcagaactttgtatgtatatgtcacatcattttgtccttcacattctccagttgtgctaatttttcccaatccattaagtagagtaccttcctttttggagtcttacttttttttttttttttttttttgaggcagagtctcaaaccgtcgcccaggctggaatgcagtagtgcaatctcagctcactgtaacctccgccttagcctcgtgagtagctaggaaatacaggagcatgccaccacacccagctaatttttgtattcttagtaaagatgggggtttcaccatgttggccaagctggtctcgaactcctgacctcaagtgatctgcccagctcggcctcccaaagtgctgggattataggcgtgagccaccacatccggcctccttacttaaatatcttaatgtgccttagaatgtagttaagaattttcaggtgacagtatatttttgatagttatctttggtttccaaacccagagaaggaagagtaactggctttttctctgtgtgggtacattgtgtcttattggagattgttttgtctcaagtattgctgcagactattttattaatgggtgcaactttaaaatttttttttttcagattaacggtttaggtatcccagtactcggtatttgccaatttctagaattaaaaacatgtgtgtatcactggttaactagaaatttaaaatgaaaatgtttcttctttagcccaggcaatatcacttgcattcacttctatcccctccttgtccctactctgttggctccagggcttcttccactaagctggtactttctttatacctcctgtacttccattcactgaacctttattggttcatagcctacagaaaatgcctgtggtgtgagaggtaatttgtgaaactgcttctcttcactgtttagcaggttgagctctctaaatgggtgtagctgggaaagaaaatttaactttacaaacaagaattcctgggttccatccagtggaacatgtcttttgttatacacacacagtttctgactcatatcattccatgacttatgataaaatggacattctgtttacactgttgtgtggaaggaggggtctggttcctaatttttagtaacatctatttctagaatattaggcttgccatttgaatgcttctgtttgatttatgaatatcattggttccagcagtttttagctccctgctaaatgcaagttaaaatttttaagtttctaagttaaaagaaagtaacttttcctccacttaagaaagcaaggaaaattaaaaataatgtagtgatgacttccacaggctctaaaagagcaatgaaaaaagtgatttatgtgtgggagaagaaatactagttcttaattaatacattgttttaccacttcccgtgaatttatgtagaagtaatgaaaccaaggtttaagtcatttgttcaaactcctgtcagtttagactttttaattgctttgttacatgccattgctttgtaatacttgttatagcagtggtaacagttgagatttgcctgtttgaccacttgcagggcaccgtgccagattccccatgtgcaatgttcctcgcagttgtgacgcccatcgtaggagggcggcgttagcacccctccatgcaagcggatggtgcaggctgggtcgcctgggcacagcgcctgactattttcctggcttagtgtagttatcattaaatatgtggtattacttagaagcattttgaataatttgaaaagcacattttagtgttgaaacaatttttttttgagaaaaggtctggctctgttgctggggtggagtgcagtgacctgagcgtagctcactgcagcctgcaactcctgggctcaagcgattctcctgccccagcctcctgagcatctgggactacgggcacatgcccccacacccaactcaattttttttaagatacaaaggattcatcttaatattatttacaatttttttttccttttctgtgggcctcatctgactggaaagcctttcaatttttttattttttaaattgtaaattgacaaattgtagatgtatatttatgaggtacaaagtaattttatgatttatgaatacaacattacataattaagtcaagctgattaacctgttcaccactggaaacaattgcaaatcattatcattttttctggtgagaacatctgaaatttactcagtgattttgaaatgtgcagtactttttgttgttgttgtagaaatgaggtctcactatgttggccaggctggtttcaaactcctgagctcaagtgatcctcccacctcagccttccagtgttgggattacaagcgtgaactaccatgttgggccaaatgtgtaatctattattatttactgtattcaccatgctgtgcaatttatctccaagaaatgtattcctcctgtctaattgaggctttgtgccctttgaccatcatctccccgtcacccccatccccaatgttgtatactgagtcctttcatgatatgtatggaggcttatggtaagttatttaaaagtacatgtatgtcaaaattttttgtggccatagcttttctttctttttaaaattttaagagtcagaatattcgtatattaattcagcatgtatttgagtgcctaatgtatgccattttctatgttaggaaccaggaattaaagcagtgaacataacaaagtctgccctcgtggtgctaacttgccaggtagggaagccagatactaaacacatgtataatgcaaagtcagtaataataaacgatatgaagaaacaagtaaggtaggagaggcaggaaagtgggagtgagaaagaggtgctcttttaaatacagtggtcagggagagcctctcagaatgaagtttttaacagagacctgaatgagatgggggagtcagctatacagatatctgctgtgtgctagaaaaattacctgtaattttgcattctaaaagtttaatgagtacatttatttcacaatttgagaatcaattatatacaagatatagttgtaagcacatactcccctaaatataatttgtttttacagtagaccaaataagtatgttcagcttagaatatgctctttatgatctgtataataaatacattctcttaaaatattattaatattaaggttgatgttttcagaaacatataaaaaagctagcttttaaaattgactagggaagttctctcaaactgccagtccctgagatattgtatattttctatctgaaaaacttttattctcagaattctttaaaagagctgtccctgaggctcccattacttacctgtgactcccagtggaaatcgtacccagcccctcgagaggggctgaatctgttgagagtgggagggtagaaaaaatgctgcagcttcttgtgggtaaacttcacacacaaacacccagtgccccaagcactgtgcagtcaaacatcaaccctgctcagactttcctccttgggattgagaagcaatggattatagagaaagaaaggtggcttagcactccaaaacttggaagggtaattgaccaagaccccccaaagccaaagcagtgggcatccccactttctgtataccctataccaacacgtaatggctactagatacaggggcactagtacctgtctgcttggctacctccccttcttgcagaagtggtgaaggcaatcactcaacctcaggaagggaaaatggctttctcatcttcaaattgaaagaggttggcagtgggtgaggagaataacaagtaaggatctctttcaatatacccatttgaagccaaaacctctgtttagacatacggtattttgaacctggtgactattcattgaccatgtttgtgaattatcagaaagcagaattcttgccaggcatagcggctcatccctgtaatcccagcactttgggaagccaaggtgggaggatcacttgagcccaggagtttgagaccagcctgggcaacatggtgagatcttgactctacaaaaaattcaaacattagctgggcatggtggcatgcacttgtggtcccagctactcaggaggctgaggtgggaggattacctgagcccaggaggttgaagctacagtaagcagtgtctgtgccactacgctcagcctgagcaacagagcaagaccctgtttcccacccctacccaccccctaaaaaagcaagctgaattcttgaactccctgcaaccaggtcacgcaaaccaaaggtaaaaggaacataaaaaagccttctggaaagtgtacagaaattcattgcagggtgatttttgtcttgtgaaatcatagttactgttattagcagcttttttaaatgttttatattcattttttatggtgttctgatgtatgagctgcttcaagtgtttttggacatagcttgggtataaaatgtaaaaagtggatattttcaatttgtagctttcttttttgaaacttactgaaatttgttctaaatatatctccttctttctcacccaccccaacacattttttaaaaaacaccaccaggtatccgttatagcactgatgtgagtgtagatgaagtaaaagctttggcttctctgatgacatacaagtgtgcagtggttggtaggtgatcgcttttcttgctacctaatgagaactctggggaaatatgtttacacacatgttactgttaagatgctatagaaatataccttatcagaactgatttttttttaagttgtactctttaagacctgcatcatttttcaattactctaaattaagatatagcctttttttacgggagggattttttttacgggagggagctaattggattttaagtctagatctttgttttcaattcctcaacatattctataaataagaccaaattatagtagaaggagagtaaataagctattatctttttaaagtggtgaagagcactgattaaatatatattagagccccagcccccgccccagctgcgcgggcccccgcctggcccatggactgcacagcccagcgggcgccttgagcgcggtgcgggtcctcggagcacccccgaggtgagcgcaagcaaggtccggcatcatgtgctaggttattcccagtgcgaggccacacttgggccgtcggagcagcccctcctcacttcaggggtcaccctccccaagacccattgccccatcatggccggggaccggctccccaggaaggtgatggacgccaagaagctggccagcctgctgcggggcgggcctgggggggcctggtcatcgacagtcactccttcctggagtacaacagctggcatgtgctcagctccgtcaacatctgctgctccaagctggtgaagtggcggttgcagaagggcaaggtgaccattgtggagttcatccagccggctgcacgcagccaggtggaggccactgagccacaggacgtggtggtctatgaccagagcacgcggccgcagacagcttcctctccatcctgctgagcaagctggatggctgcttccacagcgtggccggctgcttccacagcatggccatcatcacggggggcttcgccaccttctcctcctgcttccccgacctctgcgagggcgagcctgctgccctgctacccatgagcctctcccagtcctgcctgctcgtgcccagcgtgggcctgaccctcatcctgcctcacctctacctgggctcgcaggaagacgtcctgaacaaggatctgatgacgcagaatggaataagctacgtcctctatgccagcaactcctgccccaagcctgacttcatctaccagagccacttcttgcaggtccccatcaacgacaactactgtgaaaagctgctgccctggctggacaagtccatcgagttcatcgataaagccaagctgtccagctgccaagtcatcgtccaccatctggccggcatctcctgctgtgccactatcgccatcgcctacatcatgaagaccatgggcatgtcctccgaagacgcctacaggtttgtgaaggaccagcgcccgtccatctcgcccaacttcaacttcctgggccagctgctggagtaccagagcagcccgaagctgctggccgccgtgcagggcgacgcgggcaccccctcaggaatgcaggagcctccccccagccctgcggccggggccccactgccatggctgccaccacctacctcagagaccgctgccaccaggagtgcggctgccagggagggcggcccgagcgcgggcaggaagcccccggcgccccccacggccaccagcacgctgcagcagggcctgcgcagcctgcgcctctcctcggaccacctgcaggacaccagccgcctcaagccctccttctctctggacatcaagtcggcctacgcccccagcaggcggcccggcggcccgggcccagcgaccccggcgaggccccgaagctctctgaaagctggacagccagtcggggccatgctgggcctgccctcgccctgcccggacgccgcgcccaggcacacccacggcccggcgcgctatcccgcgcgcggcctgaacttcggctacgcggctgccgggccctggccagccggccagccccggagcctggacgccaccgctcgactccctgaagcgtcctcggtgcttcagccccgagggcgtgcaagggccgggcagggtgctgtttgcgcccttcggccgggcgggcgccccggaacccaacggctgcagcgacctgccacggcgggaggcagcaagggctgagcccgggacgcgcggaccagctggtcagacgagctggccccggattcgcacttcaagtgctgcagctgccagatggagttcgaggagggcatggtggaggggcgcgcgcgcagcgaggagctggccgccctgggcaagcaggggagcttctcgggcagcgtggaggtcatcgagatgtcctgacccctccgctgccctcggctccgccgcccgcagctgggcagttataaatatatattatatataatgcaaagaaaggcaaatggttttactgcgatttttatccagaagtaaatatttcgattttttatttatttaagctgttcattctggcactgatttggcaacagtgcgggtggtcctcgagctctatttttactgtctggtatttaaaccgaaacacgcgtttctaagcaataagaggccaccttcagtcgcaagttgcaggccaggcctggggcccctccctgttcccccgccccaggaaacactgctgacatttgcagaggctgccgagctttcgtgaactttttacacaagagaaagttgaaaaaaaaaaaaactttcttgccacaaaccgagccgcagaaacacccttcttcccccacccaccgcccctgctctctcccttcgggctccgccccaaagccataggctgggggagcaggacctggtgtgccccagagaggtgcggccagccctccaccagctctaggcaccaaatcttggtggcagggagggcaccccgctgcccgttgccccagagctgttccctctcaggggaggacatgcattgggccccatggtgccagggcgttgagaggggctgaggaatagaacagtgtgtgtaggggcttggggcagggggttctggagggtcagatgaggcggagcccaggggaggatgggggtgttattaatgccccaactcctgccagagccccagtccagccactgagtgcctcagaaaggccattcccagagggctgcggccctcccttctcctttgcccctgcccccagagctacctgactggcagggcggcactactgcaggagaggagcttggcctccgggggtcaggcaggaggggggcctggctagcctgtgctggctccactgggcggggagccctggaccgccaggtatgaggagggggtgggcttagggtcctgttccaggtccgtcccccacctagcaaggccccaggcaggacttggaaaccaggtgtgcacctgcaggctgaggggctccatgagcaggtgctgcctcgcacagggagttcaggcgccagccaagcccctgtgcttctggggtaggcctgcttcacttagggagcgctgcctcaaggcagataaagcccccttgttgacccgacctgcatgggggcctctcaggagagaaactctcgtgcgcccctttcccagggcgccctctttctagacagcattccagcccccaaacacaggtggcttttgggcccagatgggtcagcctgctgctcctggcccataccctctcaggccgttgggactcctgcccttcagatgtcctagggtctaggagtgggccagtcaccctgggaagaggccaggggcttggcaggaggggcggcccaggcgggacccagtcctgagtcctggagcagggccagggaggcgcccgccccaccccagccagccgccttctctgctgtttcttctatttgttcttcttttcacccacagccttgtgttcctgtcaaccctcctttcagcaaaagtcctgttcccgttccctctgtccccacccactcctgttccccaagaaaataagctatcattgttgcatttgcaatctatggattagaggtttaagtatttattattattggttaattattattatgttttatatatatatattagaacttggctagccaattttattgaacaattcctgttcaataaatgttgtttaaagtacagttgagaaaacgatggtaggtttatttcttgaactttcagaaattcaagcttaaagcatcacacgtttttctaatatcatgtggcgctttctgtcattttacttttttaacctttatatggaatagcaaccatcaaccttctctttcagatgtgccgtttgggggtgctaaagctggtgttaagatctatcccaagaactataccataagtatgaaagtttttgtttttgtttttgtttttgtttttgcttttttgacacagagtcttgctctgtcgcccaggctggagtgcaacggtgcgatctcggctcactgcaacctccgcctcctgggttcaggcgattctccttgatccagtaactgggattacaggtgcatgccaccatgcctgactaatttttgtatttttagtagagagggggtttcaccatgttggccaggctggtcttgaactactgaccgcaggtgatctgcccaccttggcctcccagagtgctgggattacaggcatgagccaccgcacccggcctcaaagtgatatttgtgcacacagtgcatttatgaaggacttgaaattactgggcttctctgtatcccccatatcagtgaaatcaatagtccccattgcttttcaaatggaatgaaaaaagtaaagaattaactcattgagtgttttgccatataaaggtcacctacttaatatctatatcctttatcattttctgttttgtttggttttgtttttatgagtcttgttttttttttttttttttgctttttgtattattattttcttatttaaaaggtaattaatatcttcatattattagacacctatacccatatttaagaagtactgtgatctggctgggtgcggtggctcacgcctgtaatcccagcactttgggaggccaaggcaggcggatcacgaggtcaggagatcgagaccatcctggttaacacagtgaaaccccgtctctactaaaaatacgaaaaattagtccggcgtgttggtgggtgcctgtagtcccagctactcaggagactgaggcaggagaatggagtaaacccgggaggtggagtttgcagtgagccgagatcatgccactgcactccagcctgggtgacagagcgagactttgtctcaaaaaaaaaaaaaaaaagaatcactgtgatctaattagccaggcatagtgacgcacacctgtaatcccagctactcgggaggctcaggcatgagaactgcttgaacccaggaggcagaggttgcagtgagacgagatttcaccactgtattccagcctgggcaacagagcaagactctgtctcaaaaagaaagaagaaaagtagtactgtgatctgaagtttttaggtcaggatctcatgctagtgacaaatatcttaactaagccaataaaaaccttactttttatcctgtcagttccaagtaaattcaaactggttgtcacaatgctttacataatactaaattatctatatacaaacataaacagatatgatttttattctctttaaaattcaccatttagatggaatataattatattacaattaatcttaattaagatttggtatatttttcagtggggaattaatagaatgggaatttgagtcctggttctactatcttgtttttataacctacttttttgatcccttattttctcacctttaaaatggcattgcctaccttatgagttgttctaaggatgagaagacatgaaaatgtactataaatagaaaataagatgctagctataatctcaagcgatttttgtatctttttttatttttattgttttcttattttacaggataacgaactggaaaagatcacaaggaggttcaccatggagctagcaaagaagggctttattggtatgtgtagccacatagattttggcataaagtgggaacatctaaaaaaatctttttttttttttttttgagacagagtcttactctgtctcccagactggagtgcagtggtgcaatctcctccacctcccgggttcaagcaattctcttgtctcagcctcccaagtagctgagactacaggcatgtgccaccacacccagctaattttcgtatttttagtagagatggggtttcgccatgttggtcaggctggtcttgaactcctgacctcgggtgatccacccatctcagactcccaaagagctgggattacaggcatgaaccactatgcccggcctcctactatttgtgataggagcttttgccaaacatacaacatttttgaagacactgatcttcgtttgcttgatgtcttcgtatcttactattatctgtgtttatatgttctttgtgtgtgatctgaacattctttcctatgatatgtaaatatttgtcatttaccttctaattttcaggcagtttaaacctctctatacatatatttttaatctagaaggcttctaatttgtttgaatagaatatacataattatttaataaaatgcttgccctatcagtatagttaatagaatgttaatagttacttaataatataatacttgccctatcagtatcagtatagttaaacaaaataaggtctacttaaataggaaataaagtgtatttttctctactttctttctcagcatttcccccaccatggacaaatgcctatgaaattaaactataaagtctgggcatggtggctggtgcttgtaatcccagcatttttggaggttttggaggctgaggtgggaggatcacttgagcccggaagttcaagaccaccctaggcaatatagcgagaccccgtctctacaaaaaatgaaaatgttatccaagcgtgatggtgcatggctgtggtcccaactactaagatgggaggatcccttaagcctgggaggttgaggctaccatgagctgtgatcatgccactgcactctggcctaagtgacaaaacaagaccacatctcaagaagaaagagaaaagaaataaagctattcagattcatttttaggaaaaaagtcatgaaataaatgtcatgaaataacctaatatagaaatacagtaagtataggtaactctaaaacttgactagatttggcctgtctttcataataaaaggcatttgggcctttgacgtgccgcatacccagcactactgtgaatttgtgcatcattacgaggagcctattaacatgagtgaactatctcactcacacttttataggagtacctaccgattctgagatatggtgaattgaagtcatgttcagcctgttaatagccttcataattttcaaaaggtctttcctcctcacctaaatctcaaacacattttatagtcttgaatggtttcagactttattcagtcatatttatcgcccatatctgcaatatctccagctaaattttatcagtcttgacaagtacctaataattccaaaggtcaaaaagtgattcattggaatactgaaagaaaacacagcttaaactctagtaacttgatttatttgcctaattcgcaaaggcctcattgacccatgatgcagctaaattgacgtcttggcccagacagctttgaagcctaggaggcaggcaaagggagttttttctctcacttctcggcaaaccttcaaattcgatgctatttatctgttatttcctgacactccacagagagtgtcagattgaggctcagacctgagcctgagccctgatcctatcacatgtgtgtttagcatcagcttgtaaatttctacaaaacaaaacaaaacaaaaaaaaagaggctgggattttgataggaattgcattgaatctgcacaccaatttgtggagtattgccatcttccccaccctccccaaaagggttttgccctttcacccaggctggagtaccaggcagcagtcactgcaaccttgacctcctgggctcaagcaatcctctcacctcaccctcccaagtagctagaaccataggcgtgcgcaactgcacctggctaactttttaattttttgtagagacatggtctcatcacgtatcccagactggtctcgaactcctggaatcaagcaatcttcccacctcagcttcccaaaattctgggattatgggcatgagccactgcacctgaccagtattgccatctcaaccatattaagccttccaatgctgaatatgagatgtctttccatttatttaggtctctgatttctttcaatgatgttttgtagttctcattgtagaagtcttacaactaagtattgtattccttttaatgctattctaagtgacactgatctatcgttttcttatgatgtctttgtctagtctttgtatccagacaattctagcctcatggaatgagttgaggagtgttccttcctcttctgtttttggaaaagcttttgaaaggtcggtgttcattcccttgtgtgagtgtaaatatcacctatgtaaagttctgcaggaccctgatgtctccacccttctcatccccttatatctctgtgcaccaaaattaccctttcatctcctactctatagtcacatgctgttagaaaagttgcttttttaaaaaagatgaacttctgcctcagaccgtgctctctatataagaatttacctgttaggccagtcgcggtagctcatgcctgtaatcctagcactttgggaggccgaggcaggcaaatcacctaaagtcaggagttcgagaccagcctggccaacatggtgaaaccccgtctccactaaaaatagaaaaaagtagccaggcgtggtggcgggcacctgtaatcccagctactcaggaggctaagggaggagaattgcttgaacctggaaggcagaggttgcagtgagctgacgtcatgccgttgtactccagcctgggcaacaagagtgaaactccgtctcaaaaatataaaaattaaaaaaaaaagaagaacgtatctgttattcaggagctacttgtaatctgtgcatcccaatacattagttttgtatggagcagaaaactagtaagcctaataattgataccttgtgattttgttttgggtgggtgaagctgtttcatgtttaacatgtatagactgtttttgagaaggattttatcattatatgtttgtgatttacaaactgtgtgcttcagacttgccacttgccagagcccttctccaattggaattgttttttgtttttgagacagtctcactctgtcgccaggctggtgcaccgtggcgtgatctcggctcactgcaacatctgcctctgaggttcaagcaattctcctgcctcagcctcccgaatagctggcactacaggcgcgtgccatcacgcccagctaatttttgtatttttagtctacaacggggtttcaccacgttggccaggatggtctcgatctcttgacctcgttatccacccaccttggcctcccaaagtgctgagattacaggcgtgagccaccgtgcccagccagcttttttgtttttaaaatatattgtttaatcaagatgggatctcactatgttgcccaggcttgtatcaaattcctgggctcgagccatcctcctgcctcagcctcccaaagtgctgggattacaggtgtaagccactgccccagcctagttggaattgttgtttgaggtaacaagcttacttaatcctaaagcaagcataatactttcgtagatgcctctagaaagattcgggaccaatttgtcatttgtacattgggagaaaaggagtggttaaacaaagttttactgacctccagcagaggtatgtcactaaaggaatggaaagtgagcaaacaggagctggagagcaccagagagcccttttgtcagtggatgaggctagaatatggcattaatccttccaagtgctgtgtggggttagacttctcatgaaggataggtttgggtaggttagacttcatgagattttttctgtttttaagttttttgttgtccttgttgacttcatgagatttttaaggtgactaagggaagggtgctaagacatagagttacagattaggtgggaggtggagagggttggggtataaaaagcagtccttgaacatttcaaagttgtcttataccagccctgtatccaatatatcacatcttgttcaaagaagttgattatctaggccttgggcccctgagttaaagaaaaacattacagtatactgattccgtcgactaaaaagtaaaatttataggaagaattgagtacagtccttagaaagaactttaattattttatggggggacataatggtttaatagtttaacctctttttttttttttttttttgagagacagagtctcgctttgtcacccagactggagtgcactggcgcaatctcagctcactgcaacctccgcctccagggttcaagtgattctcctgcctcagcctcccgagtagctgggattacaggcacttgctatcacgcctggttaatttttgtatttttagtagagacggggtttcaccatttggtcaggctggtctcgaactcctgaccttgtgatccactctcagcctcctaaagtgctgggattacaggtgtgagccacaacatccagcctaatagtttaaccatttttaaagttgtgtttttctttttgtaaagatgagtttctattatacagttgaaataatatagaaagttataaacaatatatatatggtgggtagaaagaatggggaagagaaagaaaattgtaagtgggaacatgttatacatgttgtatgaaacctgcctttttccatatgtatgtttgtgataattccaagtaatttacatgcatatgttatcctttttaatggctgtttagtactttgcataggtataccatagttcatttaattgacatacaagataattagattgtttttatttttactatgtttgagaggagtatttctgcacctttacggatttgagtgagcatcacttaacatgtttttatcagagatcttactgtagccgtcagtagtagtgcagtcagtgatttctgttattgcctgtaagctaatttgttagcctaacacttcaatttgctatgatctgaggaactgaaagctaaggcctaaaattttatatgtgctaagtgtcgaataataggtcaaagctgcattcttccacaagtaaagataatatggggcttaacacaattgctttagcaatgtgattttctcccctttttctctacttggtaaggagggcttatacccccactaagcaggcacatgcctgtaatcccagctactcaggaggctgaggcaggagaatcgcttgaacctgagaggcagaggttgcattgagctgagattgtgccattgcactccagcctgggcaacaagagtgaaactcaaaaaaaaaaaaaaaaaaaaagaaagaaagcaagcaagaaagaaagaaggaaggaaggaaagaaagagagagaaagaaagaaaagtaaatctgtggatattgtacaaaagattgttttatgattttttaattttttaacataacttttattgacttgtatttgtatttttatcaaacatacttcatttgtttatttatttattttgagatgaaatctcactctgtcacccaggctggagtgcagtggtgggatcttggctcactgcaacccccgccttccaggttcaagcaattctcctgcctcagcctcccacgtaactgggattacaggcatgagctaccatgcccaactaatttttttattattagtagagatggagtttcaccatgttggccaggctggtctcaaactcctgacctcaggtgctccacctgcctcagcctcccaaagtgttagtattataggcatgagccaccgcacccagcctcaaacatactttagacaatttttcacctcagcactattgacattttaggctatgtaattctttgttatgggggctctctctgccttgtaggatgtttagtaatatccctggcctctacatattagatgtcaggaagacccctcagttataacaatgacaaatatattcagattgccaaatgtcccctgtggagcaaattcatcccttgttgtgaactgtgatccagagagccaaatagtgatacaaggtttattgttcacaatagctcgtcccctccaatccagacatctgcctcaccatattccactccccagaggcaaccactttcaacaatcttaaatgtttcatttttattctatttaaagcctttgctcatttttaaattgggttttgtccacattattgagtggtaagagttctttatatactccacagccagttgtggtagtataggcctatggtcccagctactcagaaggctgaggcaggaggataacttgagcccagaaggtcaacactagtctaggcaacatagcatgaccctgtctctaaatgagtctttgaagtatatatattctaggtaattgacctttatcatgtatataatttgtaaatatttcctctcaatctattagttgtcattgcgctttcttgatagtctcctttttaatcttgagaaagcataatttatttttcctctggttggtgtgctttaggttgtatgtaagaaaccattgcctaatccatagtcatgcagatacatccctatctttttttttttttttttttgagatggtctcgctctgtcgtccagattggagtgcagtggtgtgatctcatggctcattgataactgcagcctctacctcctaggctcaagcaatcctcccccttcagcctcccaagtagctgggactatagcaccagctatagtcagcctcccaggtagctgggaatatggcaccaggactatagcacataccaccactaagcacagctaatttctgtattttttggagagacaaggtctcaccatgttgcccaggccagtcttgaactcccaggctcaaacaatcctcccacctcagcctcccaaagtgcaggattacaggtgtgagccactgtgcctggcctagagagatttttttaagaaatagtgaccaaaaatatcccacatttgatgggaattgtgaatctacacattgaagatgctcaacaaattcaaagcaggataaactcaaagagatccacactgacacacattataatcaaattgtagaaagctaaagacagaaaagcagcaagagataagtgattcatcctgtacaagggatcttcagtaagactaacagttgcttatcagaaatcacggagtatagaaggcagtggtggtgtgctgggcatggtggcatgtacctgtagtcccagctgactgaggctgagacaggagaattgcttgagcctgggaggtggaagttgcagtgagctgagatggcgccattgcactccagcctgggcgacagagcaagactccatctcaaaaaaaaaaaaaaaaaaacagggttggggaagctcagcatggtggctcatgcctgtaacttcagcacttttggagactgaagtgggatcacctgaggccaggagtccacaaccagcctgggcgacataaggagaccccatctctacaaaataaaaataattagccagacaaggtggctctggcctgtggtcctagctactcaggaggctgagacaggaggattgcttgcagccagcagtttaagactagcctggacaacatagtgagaccccgtctctacaaaatataaattaaaaaaattagctgggcatggtggtgtgcatctgtagttccaactactcatgaggctgagacaggaggatcgtttgagaccagaagttggaggttacggtgaggtatgatcataccactgcactccagcctggttgacagagcaagaacctgtcactaaaaaaataataaatgaataaaaatataagaatgcttggcctggtctgggcgtggtggctcacgcctgtaatcccagcactttgggaggccgaggcgggtggatcacctgaggtcgggagtttgagaccagcctggccaacatggagaaaccctgtctctactaaaaaaatacaaaattagccaggcatggtggcacatgcctgtaatcccagctactcgggaggctgaggcaggagaattgcttgaacctgggaggcagaggttgcagtaagccgaggtcacacccgattgcactccagcctgggcaaaaagagggaaactccacctcaaaaaaaaaaaaaaagaaaaagaatgcttggctgggcacagtggctcatgcctgtaatccctgcactttgggagtccgaggcaggtggatcacctgaggtcaggagttcgagaccagcctggccaatatggtgaaaccccatctctactaaaaatacaaaaatttgctgtgtgtgatggcacgtgcctgtaatcccagctacttgggaggctcaggcaggagaatcacttgaacccagaaggcagagtttgcagtgagcagagattgcgccactgcactgcagcctgggcaacagagcaagactcgggctaaaaaaaaaagctgaagtgagtccttcaggctaaaatgaaaagatacaagataataactcagagctatatgaaaaaataaaaatcactggtaaaggcaactatatagctaaatataaaagctagtattattgtattttgggtatgttattcctctttctcctttatgatttaaaaacatgcatgaaataatatgcatctatgttaataggaactaattgtttaaagacataatttgtaacaatatagctaggggacagagaaaggagcagagttaatgtatgctattgaagctgagttggtatcagtctgaactagacttagaactcagcatgttaactgaaatcttcatagtatccactaaaaacaaaactttaaaaatatacagaaaaggaactaagaaaggatcaaaatattacaggataaatcattaaccaaacacaaaagaaggtactgaggagcaaaacactttatgtagaaactaaacagcaggatgacataagtaagttctttggtgtgtgggtttttctgtttttcttttttggggtttctttgagacagagtcttgctctgtaactcaggctggagtgcagtgtttcattctcagctcactgcagcctttgcctcccaggttcaagtgattctcagcctcctgagtagctgggattgcaggcgcccaccaccagacccagctaattttttgtatttttagtagagatgaggtttcactacattggccaggctagtctcgagctcctggcctctagtgatccacccgcctcggcctcccaaagtgctgggtacagccatgagccactgcatccagcctgtttttggttttttttgagacagggtctggctctgttgcccaggctggagtgcagtggcacaatcacggctcactacaaccttgacctccgcaggctcagctgatcctcccacctcagcctcctgagtagctggaactacaggtgtgcaccaccatgcccagcttatttttctattttttgtagagacaggagtcttgctatgtcgcccagcctggtctcaaactcctgggctcaagcaatctgcccacctcagcatcccaaagtgataggattacaggcgtgagtccaaccataagtaagtttctgttttttgtttttgagtcaatctcactctgtcccccaggctgaagagcagtggtgcgatcatggctcactgcagcctcacctccaggcgggagccaccgtgcccggtcaagtaacttttctgtttcagtaatcactttcaatgtaaataatctcatcaatggaaagatcggcagaatcaatttttttaataatgtaatacataatccaaatatgcaactcacaaaatactcactgtagacccaaagacacaaatttgttgaaactgaaaagatggaaagagataatccatgcaaatagtaaccaaaagagagccagggtggctatactaataataccacacaaaatagattttaagccaaaaactgttacagaaaaacattttatgttcgtaagagagtcaaatcacaagaagatgtaacaattataaacacatatgaaccaaaaaaaaaaagggctccaaaatgcacaaagcaaactaataaaattgaaggaagaaacaattttacaatgatggagacctcaatgcagtggctctatcacagctcaccgcaatctctgcctcccagactcaagcaattctccagcctcagcctccccagtagctggaactataggcacacagcaccacacccagccaatttgtgtatttttttgtggagacggggtctcaccatattgcccaggctggtctcaaatgcccaagctcaagcaattcacccacctcagcctcccaaagtgctgggattacaggcctgacctactgcgcccagtcaacaccccaccttcaacagtaaatagaacatctagacaaaatcaataaggaactagaggaattgaacaacacactaaaccaactagacctaacagacatatagaaagctctccatctaacaagtgcagaatatatattcctctcaagtgcatatggaacattccccatgataaatcatatgttaggtcacaaaacaattctcaatacattttaaaaggtcaaaattatatgaagggccacatgtgttggctcacagctgtaatcccagcacttagtgaggctgagacaggcggatcacttgaccccagaagttcaagaccaggctgggcaacatggtaaaaccctgtctctacgaaaaaaaaattttaaaattagctgggtgtagtggtggtgaatacctgtagccccagctactcaggaggctgaggcaggaggatggcttcagcttgggaggcagaggctgcagtgacccgagatcataccactacactccagcctgcaggacagagcaggacctgtctcaaaaaaaaaaacaaaaaaaaaaaaacaaaaacaaaacaaacaaaaaaaaacaggccaggcttggtggctcatgcctgtaatcccagcattttaggaggccgacgcaggtggatgacctgtggtcaggagctcaagaccagcctgaccaacatggcaaaaccccatctctactaaaaatacaaaaaattagctggaaggggaggcaggcacctgtaaccccagctacttgggaggctgagccaggataatctcttgaatctgggagacagaggtttcagtgaggcgagatcacgccactgcactcaaccttgagcaacagagtgaggctctgtctcaaaacaaacaaacaaaaaaattatacaaaaaaaaaaagtgaactgcatgttgctgcacagtctaccatagcacaaatgtcaattgcttcttggctttcctggggtgatgggaggtctgaacctaacacagtctcacctgatccttcacaggagtcacgtagcctttctctctccagtccacagatgtggggatctcaagaagcaggcgttcctggaactgtttccccttcctgtgcttctggtattgaaaaccattcatcacctgcctgaattcttcagtggtcttcaaagaaaagtaaataaaatgttaagaagcaagagattaatttggtaaagaactgaggaggggaagcacagagctgggcagcccacagcatacttaccatgtctccaaaggcgttcatggccattgtgaagctgtgtttcccttggctgtattcctgattgtgctgctcagtcatcttcatgttctctcacactgctctcctccatccttcttcattctaaaggcaaacatgtaactgatgttcttcatttctttttttttttgagacggagtctcgctctgtcacccaggctggagtgcagtggcacgatctcagctcactgcaagctctgcctcctgggttcatgccattctcctgccccagtctcccgagtagctggaactacaggcgcctgccaccatgctaactttttgtatttttttttagtagagacggggtttcaccgtgttagccaggatggtctcaatctcctgactttgtgatccgcctgcctcggcctcccaaagtgctggtattacaggcgtgagccaccgtgccctgccgatgctatttatttctaattaaaacccaacatgtgctaaccaagtgaatcttcagacagagatgtaagagtaaccatggccagggaaggcttgacacttctaggagatgttttccaagctgagacacaacaagggtgtatgcccatatcgtgctcataatcagtgctattaagttattgcgttagcttattggtaggagccagcctctagaagccactctctggccatatgatcccaatagcaatgcccatctctctggggttcccctggacagtttcagatgccaccaaccatgtcatataatctcttgtgctttgccttccacttggtccattgtgcgtctaaactgtggtcacgtgttagagcagctgaggcaattcccaggcaaaaggcagccaggaggagtgaaggattcatgtttcaaaaatctaggaagggaaaagaaatgaggatctgattagaccgatcctaaaaagccattttactaccccctgagaaactagggccaccatggtagaataaaaatatttaaattattcttccaagcatttacctaaggactgtggaagaggccaaggatgtggctggagaaaaacagggcaagtggaggtattggagggacccaccaaaatgaaaagcagcctgtccagagctgtaggagttgaaacagttttctgggatgatgatgacaggctatgaaaaggacaggaaggtacctgatgggcgagaagcttaaggcaacaaccgggaaactaggaaaccgttggcccaggttttgtaccaattgtgctgaggtcatccaggcaaaacctcaagaatgaagacatctaatttcaagaagggacaaagggatccccaataattgggaagtcacatcacaccttgttcttggctaatacacaacagaaggtgaagtatgttttccaaatgccccttgtaatgaaacagttattgaatgtcttcccaggacaaactgggaaggagagcacccatctaccgccgttcccgcagtcctgcagtcctgcaggtgggccagtcctgccaacactccagctcccctcacagagcataaactgaatcaggtggccgaaccaccggaagccagagtccccagtgtccgcgcccacacaggggtgggtaggcagcttcccaggctttgggctggggacccaggccaggtctcctggctcttgctcccgccctccgctcatgctcactgtggccccaggacgtgggcgatgttgcagggagcaaggggcgcctctgcctgatttgccggggtcgagcctccctgtcccacccccaccggccctgggaatactgcggcctggcactccggaaaatccctcactcacagagctgaaggacttgctgggtccctggtggcccctgtccaatcttagcccactggggtctcagctgctgtagccacaggtggacaggcacagtgggcaggtgctgggtccaggagtctcctgtcgcctaaggccgcccgaaagcagctaattgacctctaaagcccctagacgcccctgcccccttgccgcccaggcaggcccgcccccaccacttgcccgctctgcgattggctgcgccagccgctgggcggggccttccggcgtgctgactcctggcatgtggagcagctcagtccccttgcctcagtggaaccgggggaggggagctgggggctacgaagagaagggtcggaggtctccctggagggttcggatcaactaagtaccctatttaatgccctgggcgggtggtttatgaaaagaaatttacaggagccctgtgtgcattttcagtttaaccctgcttttcccttaggcctagaatttttgattaaaatctcctgcagggcagagagccagaggactctaatccagtggttcctgtttagtccacagcaaaggtgcggctggctggaagaacgcacagcctgcaagcagaagccttacctcccaattaagggtgtagaagaatctgggcgtgttgctggtggctcatgcctgtaatcccagcactttgggaggctgaggcaggcagatcccttgagcccagtagttcgagaacagcgtgggcaccctggcgaaaccccttctctactaaaaatacaaaaattagccgagtgtggtggcccgcgcctgtggtcccagctagtcgggaggctgaggcaccagcatcgcccagcccggaaggttgaggctatagtgagccgagatcgcaccactgcactccagcctgggcgaaaggagaccctgtctcaaagacaaaaaaacaactggtaggaaaacgcaccctcaaaacacatgatgagatggtcgagaccagaccctaggagggtgggtactggctgggtgggtatccagagaccatgggcgtttcataatgcattgtttcccatctcctccactcagcgactcttcttcccctgaagtcttgcattaagtaagtgaatgaatcaatcatcaagttaatgaagctctgactttgtacttgttgtcctttgcttggtacagttgggcactgccttagaaacaatctccaggtaattttcccaactgcttttgtgaggcccagttttccattttaaaatctaagattacctcagtaatcttgcttttacagcaaatgggcatggagcctgacagatatatttaaactaagttatggacaagctgcctggtgcattaggtagcataggagctaaccttgtgggacatctccccatattcgtaatattcacccctacatctataatcaataaatgcttgtttggaggccatagaaactcttcctgagatctgacctgtgtcttctgctatctgcctgatttctccccatagaacaggaaaacactgtgtaggagatattgtgaatagaaatatgaatataggccgggagtggtggctcacacctgtaatcccagcactttgggaggccaaggcgggtggatcacctgaggtcaggagtttgagaccagcctggccaacatggcgaaaccccgtctctactaaaaatacaaaaattagccacgcatggtggcaggcacctgtaatgctagctactcaggaggctgaggtaggagaattgcttgaacccagggaggcagaagttgcagtgagtgagatggcaccactgcactccagcctgggcaacagagtgagactctgtctcaaaaaaaaaaaaaaaataaattacaaaaattagccaggcatggtggtgggcgcctgtaatcccagctactcaggagcctgaggcagggacaacggctcaaacctgggaggcagaggttgcagtgaaccgagattgcaccactgcactccagcctgagagacatagcgagactccatctcaaaaaaaaaaaaaaaaagaatataaataggaaatacagtgattcaaataagcaattgttagttcctcagatcagaactgtgagttctatactagactcttacatgttatttcttctggtatcttagcaatgattctgaataaagatcagactccttagtcggcaggtgggacagttctcaataacagaagctgggttctcaggggatcccgtggatatgaggatgaaggttagaagcacttgggaccatacctgcaggtctgatttgaggacaatgagaccaagacaggaaggcagcacctgctgaggggctgggggtgggagaagggaggaaacgggacacaagaaaataagtataaaccaccagactgcagtcagtgatcaacaaaattcccaagtttatattgagaagatttccctggtttggggttttgaagagattatataagggattcgggttgcttgatttttttcattctttttcttttaacttggtctcaatttttttgtaaaaaaaaaaaaaaagaatgtcttatgtgcgcctttagaactggtgaatgaatgaacctccctttttaaataactgagattgtcactgaagcactgtcatccgatttaggcttaaaaatctgacactgaatttatcctagatgataaagtgcaagtctcttgtctcctagaaatgatcaggcaaggaaacacccaggaggcccagggcaaaatgccctcctggaagctggtggggtaggaagatgctgaggcccagtatggtccctggagcatgcattctgtgtggtgacagaaattgtttgcttgaccgtacattggtcaggcttctgaaccttctgctaaacccatctgtgcactttttgtaaaattcagttttaggaaattaccctgctaagtcagtttagctggcaggaatccccgtccaccatatactgatcagggtcctcatcccccaccatcccgcagctgatgtcagataaccttggcctgtgctcagcgagaatctcgttaggtcagtttagccagaatcctcccttacccttcatgttccctcatagtcatttcctatctgctaacccccatcctcctccttgagtataattaccacttccttgtgctggattcagagttgagcacaattgctctctctcactgtaagaactacttgcagtgctcctagacctacatatgtgaacctgtttctttaacagtgactcacctgtctttttctcctttcaacttgacactagctgaggcttatccgcatcaaagtggagggactggccccgggggatcctcagggcttcaccttgatggcctgcaggctcacattccactttttctggtgccttctggctccgagtccagtttgccacacaagtgatggaggttggaaggagggatgaggtgacagaggtgaaggagggtaaattcttttctaagccctacttgcctgacatgcatttaggtttttagaaaggaacctgaccccaccctttattttctatctcccacttccatgactagccttacctgtaaaaatggggcatagaagagcccccatctcctagggcagtgtttttgagcagggggtcactgaacagtagcaccttcatctcttgggaccttgttaggaaattctggacttggggtggttgatcatgcctgtaattccagcactttgggaggccgaggctggcagaacacgaggtcaagagatcaagaccatcctggtcaacatggtgaaatcccgtctctactaaaaatacaaaaattagctgggcacggtggtgtgtgcctgtagtcccagctaatggggggctgaggcaggggaatcacttgaacctgggaggcagaggttgcagtgaaccaagatcatgccattgcactccaacctgggtgacagaggaagactctgtctcaaaaaaaaaaaataaataaaaattcctggaaatggattagcttgctgacaagagttattccattgtgtgtttctacctgcaatacctgaggatgcccattttctcacgatttataaactaactcattttatagatgtaattttcatacatttgggggtatcgttctaacttcattattattacttcaaggtgttattatttccccatcatcatcatggtcattatcataactagttggtgctgacagtagtcaccctgcattgagaactcatgctccaggccctttccacatagacttgatttaattccattcactcctcacaacaatcgtctgaaagaaagaatcactaagccattgtataattgaaacacaagaggcgagtgacttgtgtgcccttgggcaggtaatttaaacactctgtgcccccaagttccaatagataaatgtaaataataatatctttcttacctaatacatggggtcaacagttaaagtactgtacatttgtgaggtatttcatggcacctgtgaattgctcatgtgatgacttagtgtgcttccagtgtcagtgtgctgggaaggagacagaataagaagaagactgaaaagatgccgagtctagtgcagggtatcctggggaaaacacctcctgtttgtccaacagcgattggccacacattgaagacacactacctggctgtgaactggggtgaccctgttgaaatcttgtggaaagcttgagatgctccttagagggtgtttatccctcgagctggcacaaatgcggtttgttgttcagtttttccttctactctgcctctatctggtacaaaatggaattgaagaggatataaaccagcaaggaacaatctgaaatcagaatggtgacaatgggagaaagtaatcttggttcaacccaatgttcacctgaagtctctttattaaagactactaacaggaacgaaattgcataataatcttcctatgataatttcaagttccagaatttctctatggaactttcaaatttcacctctgttaactcatggaattttccctagaatctgcaaattaccgaagtctttggaggtttgatgatcactcactggtcagcggtactacaaaaggattctggggagtttgactcagtggtcagcaaaggctcttccgaatcttcagtctgattctgagattccccggggagaactggagcctttcttaacagctgttgattggaaagaccacctgcttcatcctctattgcaacagaaatagccattgtgaatctccatggggaggcacaatgagttttttctagcatgtgtgactcaggtcattttgttccgtggtttccagttgtggggacttggcaaggtcacaccctcccctgagcctcagtttcatcgctcagaaaatgaggataacaattctacttgcctcataggattgttgtgaagattaaatgagacatgtaaacatttgcttatagtaatttcacaccactttattgtggaatcaaagacagaattcttacagaggtcttggttagttaagaaaacatccattcaaagatttgattcacaggacaccctcactgtctttctctcttttttttttttttttttttttttttttgagacagggtctcacttcattgcccaggctggaatgcagtggtgtgatctcagctcactgcaacctctgcctcccaggctcaagagattctcccacctcagcctccgagtagctgggattacagccatgcactgccactcctgggtaatttttgtatattttgtagagacggggttttgtcatggtgcccaggttggtcttgaactcctgggttcaagcaatccacccgcctcagccacccaaagtactgggattacaggcgtgagtcaccacacctggcccttgcttactttcgtacttcccaagaggcaggttaccaaattggtgaaattaaccataacatcattgtgatgggcaagcagatatattaaaagcaaagatacagcaggttaacattaaattttgctcatcccaggacaaacctggccacaggaggcctttgccagtattctgaaaagtgttgtgaccatctcctttaaagctcagttaaaggtttctggctggactccaggctgcttcaagctctttacttgtctttatcattctttaaggagggacccagacacagtatgcagaggcctgaatcctctagatcattctctctccaccatgagtcctgccgtggggacttttccagctccctttggccttatgagccagaaaatcaggctagagcctaaagagaacagaaatttcagaatcaggcttgttctgcgactgtatgggggagctgaaggacacaatgggctttctatattggagactacccatcatactctctctgcccagggagaaaggacagatgctgtgtgattttgcagtctgtgatttggcttctcattctcgctgctctctacacctcattgtttacttcactcccctgaaaaaaatgctccctaacaggctcagtacccaacttctgggtattgctgcccacatttgccttggttctaccttttcagattgcaggatcctgaggttttgcttggagcagctcagattctccactagatctaagatctcacctagtcctgaggatttccttaaagggaaggggaaagatagatagatagatagatagatagatagatagatagatagatagatagatagatagatagttgctgcctttgctctacagcatctgcttggtgaagaggctcaggatctggatcctggcctctcagctctcaggaaccccattcccccctgacaggggtggcaagttcatcctattattcattaagaaatttgaaaacaatcattcaggaattttaggtcaagagctggaaaaccccaagcctccatcacctgagcaaagggagatactgtgagcacctgcaggatacacccatgttccaccacctgcctgaagaagcctgtggttcttgtcagcttctcaagggtgaagtgcagatccttttctgcttgagcagaagagcagaccaaagagctcattgactcaaggagcatcacggcaactgagctgcacctggaagagaagaatccagggtgtgatccacagccaaggcctgaagcaatggggcccatacttggcctctccagggtgagttgtgacccaagtgctgggctttagcccatgagtggtccctcttgccatttccagtttcctcccaaagagaggccagtgttggtgatttcatttcttataatctccttaggagcacaggttttggtttgtgccttttttggatcaggttccctgcattgcagctgctataattaaaactattaacaacaacacagcaccacagaagcaagttagttgctaatggaatttgctgataatgctgtcttctagagaccactctagtaactggagagccttggtgtagagctgatgataaaacctattcctgcttttgtcagtcatgaggagcatttcctttctagacagaggaactgaaacccacatgccagcccaaatttaccaaaagcagtcactggaatactcatcacaccatcatgtctcatcttatccctttcgttaccttcaaatacggccccgtttcctcaggaccagaactcccttatgtgggcagcaggactaaggcccttgagttacctgtggtgactcctcattaaatggaggaatgtgccagtattttcagcaaaacatgaatctgatgaaacactgactgaactgtctcctagtttcaaaacaaattattaccactcagggcctctatttagggcaatcagagtcagaagtgggaacgcatcttgtcctcctaccttgattaacagtaactctaattgcaggatgatggtcaaatcctctctcctctaatgtgcagttgtgaaggatttaggctccactgctcatgcatttgggtggggcctgaatcactttcagtctagcacaggcgggtcacttcaggccttcccacctccatcagcatccttcaatcctcccctgacatctctcatttatgcttcctattgattcagaggtcccaacccgagtggctaaaagaaacattcattaacctttctacaaagtcatgaataatccatggattacattgaattcatccctactaaaaccatcttcagaaattcagatgtagtaaccttctttctgaatttttttttttttttttttttgagatggagtcttgctctgtcgcccaggctggagtgcagtggcatgatctcagctcactgcaagctccacctcccgggttcacgacattctcctgcctcagcctcccaagtagctgggactacaggcacccgccaccatgcccggctaattttttgtattttgtttagtagagacggggtttcactgtgttagccaggatgatctcgatctcctgacctcatgatccgcccacctcggcctcccaaagtgctgggattacaggcataagctaccgtgcccagccaagtattctatccttaatgaacacatatatgcacattatatctattttttataatatatatatttagaattgaatgtcagagtacatatcagtgttggaggaagagaataaggaggaagcacagaaagtaaaaaggaaaaataggcaccaaaaaagatttggagaatggcagatggccaaggagatgcagttgggaagtgcctcttccatggagaggaacccaaatatctagtaaaccttcacattttaaacagatcttttgagagaaaacactgaaagttgacacagaggtgacacagacaccatggttgaagagggaagaaatgggacagtctgctcagagtcactagacatcaggactggcccatataccctgaacaaacccaaggaaggggtgagtgaaggaaccctgggacactacatacccataatgtacctctgagatcctagttacaggagtttctacgaccctcatagatctttggactggtaggagagctgcctcgagcacatgcagaggcacagtttgaacccacacagagcccagaaggctttgttgtgctgtgcagctgcagcaaaatgcaaccctaggtgcccatccctcaagcctccatttcatactgagtggctaagttcctgctgtccgccaggctgggagtgaaccacgcctggcctgctcacatgcccaagataggccccatcaccagtgctgtgtgattaagttgcatctggtccacatgcccccttgcctgtcaaccccttcccagagctcatgcctggtcacgcctgcaagagggtgtccacagcacagcatccactgcatagcttgagtgttttgttgacagcctgggaaaagctcaccaccctgtccccaagtcacagccagtgcttgaagcttagaggccagaggacaaatccgtgagcccagtcccaactccccaagactcaagtataccacccagggacactgagctgagatttgtaacctaatctcaagtgaaggaggatcctccatagtcagaatgcagagaagggtgtggtatgggttctcatgggggcatgggaactggacacccctccctttgcaagaccagaccatgaagggtatggcctgatggtggtagcttctttcccagggagtgtcctggcacagaatgcctggagcagctcaacaatgtgggagcagatggcttggggaaagcctagttggttgggcttgccgccagggcgagtgtctgtgggagatctgctgggtcaggggagtgtaagctaggcagactccatggttgcctgctgggctgaaaatcatgggctgcagactccatactggtgttgcacccattgtgccactgccctgcctggagatcctctacccttgaaatactgcatcatcagagcaactgcagacataccctaaaacctgctctgactttggtaagcacagtggactggtgggtctctggagagttgtgtgtccctagagatgtaatcctcagtgtggaccatccctaagggaagggggagtgcagcctgccaaagcacaacatgagacaaagaaaatgcggccatggcataagccactgaaaggagcaccaccaaggcccagaaccagacttggagaaggaattatgtctcgcctccatctcccctccccagtgcactgttgcagatgcaacaatagctcttcccataggggcccagaaagcgtgcactgaaagaagttgtttctcatgattctccagtgagggcaagcatgcaccaagaccccacctgccagctcttactcttaagtccatctaccagactgaagtttgagttataccatcatataaaaatacattgctaaaacaagcaacatctgtgaaagccactgcagcaacctatctgtaaccaaggaacatatatggaaacttcaccctctgcaactacagagaaatgaagccaatcaatcacatacaccactgtcatactttcaaagagaataaaaaatataaaagccctgtgatggttaatactgagtgtcaacttgattgtattaaagggtgcaaaatattgttcccgggtgtgtttggagggtgttgccaaaggagattaacatttgagtctggactaggagaggcagaaccaccctcaatctgggtgggcaccatctaatcagctgccagcacggctaggacaaagcaggcaggagaaggcagaagagcagacttgctgagtctcctggctttcatctttatcctgtgctggatgcttccagttcttcagcttttggactcttggacttacaccagtggtttgccaggggctctcaggccttcagccacagactgaaggctgcactgtcagcttccctacttttgaggttttgggactcggactggcttccctgctcctcagcttgcagatggtttattgtgggactttaccttgtgatcgtgtgagtcaatgatccttaataaactccccttcaaatgtacatctatcctattacttcggtacctatagagaactctgactaatacaaaccccatctaaatgaagcaaattcaaaaaagaagtgtcaactcccgcagatggaaaggaataagcacaagaagtctggcaatacacaaagccagagtgttttgtgatctccaaagcctctcactagctccctaggaaaggatcctgaccagatgtaaatgtctgaaatgagacacatagaactcagaagatggatgtcaatgaaagtcaatgagacataagacaaaatagaaatccaatgcaaagaaaccagaaaaacagtccaagatttgaaagacaacatagttatattaagaaagagccaaactgaacttctggaactgaaaaattcactaaataaatttcaaaatatagttgggagacttaaaaacagactaggccaagcagaaggaaacacttcaaagcttgaagactgattcttcaaattaacccagtcatgcaaaaataaagaaaaaatattttttaaaaagacaaagccttcaagaaatatgggattatgtaaagaaaccacttctacaacttattggtattcctgagagaaaagaaagagtaaccaacttggaaaacatatctgaggaaaaaattcaagaaaatattctcaattttgctagagatgttgacatgcatacaccagaaatccagagaacctctgttatacactataaagacagccatccccaagacacatagtcgttagactatccaaggttaacacaaaagaaaaaacaaatctcagacacagctagagaaaagagcaacactacctacaaagggaacccatcagactaacagtggacttctcagaagaaaccttacaatccagcagagattagaggtctatttttagtactctaaaaggaatgacattccagcataaacattcatattcttcaaaactaagcttcataaacgaaggagaaattgagtctttctgagtcaagcaatcggtaagggaatttatcaccactagactagccctgcagaaatgcttaagggagttctaaatgtggacatgaaagaacaatacacagaaaaagcacagttaagtacatagtccacagactctataaagcaactacacaattgagactgcaaagaaactagctaacaaaactatgacaggaacacaatctcacatatcaatgttaaccttgaacataaatggcctaaatcctccgcttaaaagacatacagtggcgaattggaataaaaaaatcagaatcacccatctgctgtcttcaagagacccatctcacaactaatgacactcatgggttcaaagtaaagggatagagaaagattaatcatgcaaatggaaaacataaaagagcaggagtttctattctcatatcagagaaaacagatcttcagccaaaaacagaaacaaggacaaaattgttattgcttaatgacaaagggctcaattcaataagaataattaactatcttaaataaatatgcacccaatattaattggagcatcacgatacataaagaaatcactactagacctaagaggtagacagcccctcagtaataactgggaacttcaacactccactgacagtggtagatagattattgaggcagaaatctaaacaaataaattctggacttaaatttgccacttgaccaattgaacctaatagacatctacagaatactctacccaacaaccacaatatatatatttttttctcatcttcacatggaacatactctaagagtgatcacatatgcagttataaagcaagtgtcaagaaataaaaacaatcaaataatatcaagcatcttcttggaccgcagtagaataaaaataaaaatcaatagcaagaggaactctaaaacacagacactcacacacaaacacacacggaaactaaagaaattactcttgaatgacttttgtttgggtaaacaataaaattaaagcagaaatcaaagaattttttaaacaaatgaaaatagagacacaatgaacaaaaacctctgggatgcaataatagcagtttaaaaaggaaagattatagtgctaaatacctacatcaaaaagatagaaatatctcaaattaacaatctaacattgcacccagagcaagtagtaaaacaagaaaaaaaactacatccaaatatagcataagaaaagaaataacaaaaataagaacaggactgaataaaatcgagactcaaaaatccacacaaaggatcaacaaaatgaaaagttggttctttgaaagtgtaaccaaaattgatagactgcaagcaagattaacaaaaaagaaaagatccaaataagcacaatcagcaataacaaaggcgacattcaatcgagtcccacggagattcaaaagattctcagagactactatgaacatttctatgtgcacaactagataacctagaagaaatgaatacgttcctggaaacacacaacttcccaagattgaaccaggaagaacctgaaacactgaacagaccaacaatgaattacagaatgaattgaataagtaatagaagcctaggactagatgaattcatagctgaattctaccagacatacaaaggggagctcatgccaatcctactgaaactattccaaaaaatcgaggatgagagattctcctctaacttactctacaaaacctatatcatcctgataccaaaatatggcaaatactcacacaaaaaacaaaaccctaggccaatatatctgatgaacatagatgaaaaaatcctcaacaaagtacttgcaaaccacattcagcagcacatcaaaaagataatacaatatcaagtgaactttatacctgggatgtaagagttgttcaaatatatgcaaatcagttaatgtgattcaccacataaacagaatttaaaatgaaaaaaaacataagattatctcaacagatgcaggtaaaacatttgataaaatccaacatgccttcataattaaaaccctcaatagactaggcattcaaagaacatacctaaaataataagaaccatctattgacaaacctagtctacgttatactaaacaggcaaaagttggaagaattcccataagaataagaacaagacaagaatatccactttcaccactcttattcaacttaatactggaagccctagccagaatgatcagacaaaagcaagaaacaaaaggcatccaaataggaaaagaggaaattaaattttatttcttcactgatgataggattctatacctagaaaaccctaatgattctgaccaaagactcctagagttgattaaaaatttcagtaaagttttaagataagaaatcaatatacaaaaagcagtagtatttctatacaatgcaatattcaaactgagaaccaaatcaagaacacaatcccatttacaagagccacaggaaaaaaaaaaaaaaagaaatacttaggaatacctctatccaaggaggtaaaagatctctttaagtagaactacaaaacactgctgaatgaaatcatagatgacacaaacaaatggaaaaatattacatgcttatggattggaagaatcaacatcattaaaatgtctttactgcccaaagcaatctacaaattcaatgcagttcctatcaaactgccaaagttatttttacacagaattagaaaatcaattctaaaatttgtatttaactaaaaaagagcctgaatagccaaagcaatcttaagctaaaagaacaaaggcaggggcaacacattacctgacttcaaactatactacaaggctacaataaccaaaatagcatggtttgggtacaaaaacagacacatagaccaatggaacaaaatagagaatccagaaatgaagtcccatacctacaaccaactgatctttaacaaaattgataaaaatacaatggggcaaggataccctattcaattaatggtgctgggaaaactggctaaccatattcagaagaatgaaattagactcctgtctctcaccatataaaaaaattaactcaagattgattaaagacttaaatgtaaaactttagactataagaagcctagaattagacctaagaagctcttttggatattggcctatgcaaagaatttatgactaagtactaaaacacaaaagcaacaaaaacaaaagttgacaagtgagaccaaattaaactaaagagcttctgcacacttgcatgttatattgcaaatatgaaatagcaaagacatggaatcaacattggtttccaacaatggtggattggataaagaaactatgatgcatatacaccatggaatactatgtagccagaagaaagaatgaaatcctttcctttgcagtaacatagatgtgcctggatgccatcatcctaaatgaattaagatgtaaacagaaaaccaaatactgcatgtcctcacttataggtgagagctaaactttgggtacacaggagcaaaaggatggaaataacagacactggggactccaaaacaggggaaggaaggaaggcaaggtttgaaaagctacttattgggtactatgtttactattcagataatatgttcaatagaagcccaaacctcagcatcatgcaatatattcatgtaacaaatgtacacatgcatgcttaatctaaaataaatattaaataatcaaataaaatgatttccatgaataaaacggtagatatgattatgtggaaaatgctttactatttattatgtggtgaataatttaataatatttaataaatacatgaatgaaaaatagctacaactgtgtgttaggatttcaataattttttatttcattcctataacttttatgtattattatatacataataatatatagttaataataacaaaaacaacatggtattgaaataatttccacccagaaggaggatcaacatatttaagtgactacactactcgagataaaaatcatttatcaaacagatcaaagtcatttacctgctttcctttttataggtcctaggaacacacgtgccatagacaataaaacatcacttcccccatcccactaccttggactttatttaacatctttgggtagaacagaaactgttgataaggtgagttttgttttatagacaagagaggaaaatggatactttttgtggtctgggccttagaaacagactaagatcttttttttttcttttttgctttttttactagcataaaatattaattggcaaaacaccgaatacaagcttcactatcataaaatcaaaacatttaagcaatattccaaaaaagatttgacaaaaactagtcaccaagagtacaaaaattacacatcaacacaaagcataaaaaatgtgaactttcaaattaaacagtcaaaaacatgtacctgcgtgatcacctccacaccttgactgccttcgtctgcagcacgctgctggtaaaggctgggtggctgcaccgtcgtcccctaacccaacattgctttcatctgggaaaattcgcttgatagccaattaagccatggaggctattacatttacacggggctacgcacaatctcaggggacgctcaaacagcagttcgttcctcacacgcactgttgggtgcaaagggcacctggagagtgagggagacctgggcgctttcctgcggggccttggccacgcggccgtcgcccgcaccctgtcccttgcctggcaggggacacaatatttgtacagattatggtataatttgaatgattttctaatctacttatcttaatttatatagtttatttaaatgtcaaggcagagaaatacattgatcatgttaaggtcacgtgatgtggtggcgcagtaatgacttcctgaggaaacagaaatcggatgttttgtgatttagctatgtgcactaaacttattttccatgttttgagagcacattaaacattcacgtacaatgtgggaataggctggctcgtaaccaaaacgtccaacccaatgccaccctttgaatcgctgtgaacaccgtcctattgcggttcagagaaaacaagcaaggctgcgaagccccggggttcaggcagctgcagcgcttgggccaaggtagctccgctctctggtctgaagccacgtggccccaccccggggcggcctggcttttttatagtgcttattgctgtgtttggcatgccattcaacccatcgggatgttggatagtgacttgagagcaatccctagatttgccctgtcgggatgttgcatactgagttcggaataagccctgctcaactgaggcactatcactaggaggaggcactgattcccgcctttcaatgctatctattggtgaaagaggagttggatggcatctgggaaattagtatcacttctactttttcttcttttcttttaaaggttaaaaataccttgtattagttaatactgctataaaatatgaatatccaaatctctgtggctcagtaaaatagatttttttttcactcagagaaagttcaggttcacccttagtaacccaggctgacagagactcttccattttctatacatagcttccccaattgcccagagaagagtggaaagatttgataggtgactgtacacaagaataagaacttagtacctagtcactaatttactcgttgaataaacatttatggagcttaacatattaatcactgggcagacgctgggacacaagaaaaatctttaagatatgtcactgcttattaccaataatgttctagtgagtaacaagagttaataacacgactaattatagtattgtaaatataattacagttccaataagacatacacacacacagaacgattttgtctggttgttgaggaaatctttattgatttaagatatcttttgatgaacaggatttttcaataactatcagaaaaagaatgtctatgacttatttttaaaaactattttcttatctgccttgcatatctgacactttcatctcctatcttccttgaatacaatatagaacctgacatttctttcctttcaaagatccttagagcatttcctacatttaatctgaatgtctttctcagtaatttttcccatacaagcaattatggctacattttcttaatataatcatgaaaaggtgagcaaaactgaaaatttaatttggagaatagatacgaaacattcaattaattcaagttgttgttaggctgcatatgttcagctttcagtgaagatgaacaaatgatgataaatgagaaactgaaagaaaacaaaccaataggtgttttttaagaaacaatattattaaagtgcatgtgttttctactgaatgaaagcaacatagaccttttcctcacattggtagttagtaagatgtataaaaacaactttgtaaagaacaattaatacaggttaatgaatcattgtgaaaaggggataacacactttattgtagcaatgatctgcaaggtgttaaatgttaaaaaagatgaagaacaattgagtagttatttgatcacagtgtttattaaattgcttttcctgtatctggcaagctttacagaaatgtcttcaacagaataactgtgttaaaagccaaatgaaatgcattttgaaatatgattcttcacttggtgtgcaggtataatctcaggtgtaattcagacaagagacaaattcaattttaaagttccatttgttacaatttgatgattgtgattaaagaaccataaaaattttatctttgacatttcattttttcctcacaaaagtattctactgcaattttcttagttttctttcctcttaactgtggtgttacctataaatgctggatttctctgttttacgtgcaacaaatctacaatcaactatttctggaacgccacttcattttaacaacaaggacccataaatattttaaaaattcaaaatgttatatataaaatgttaaatgatacacataatacatttctaagtagtaattatgattatgcccataattatacccataatttaaaaatatgttacctgaagtaaattattatacgttttatgttggaagtgttcatttatctttgatctctgttaacacattgtactatgtggtaataatataaactgccttactggatagtgatgtatctttggtttcatattgttactggactaatattccaacactatagatagtgaaatttaacattgaaacaatttgataatgccatcaatgaatccagtttttaagagtgggatccattttctaaaattgagtatatagatacttcatgagatatcttatcatgcatcctaaaccaaaccaacctcttcccctgactgtcttacagtgtattattattattttatccaccacagcaactagtacatttttcagaacctagtagatattcagtcattgtctatggaatacatgaacacattctgaatttggacagtcatcattcttggtgttttaaaacaaacacttcctgaattgcatccactattttctaagaagccctaggaattcattgaaggagggtatgggtaagttgtgggtgaaactgtaaagatgtaggtcctcctcccaaaacttcttcagcgtatcttcattgctgtttgtttgcttgcttgcttgcttattttaaaagagatctagatatagtctaataagaattgtataaatgtgatgttccacaatgattctaacttacatggtgcaaaataataaaatattacattctacctgtttgtagaaaaccatggatactataaaggatctagattttctctctcctttccttctaagatttattcactcagcaaagacttacctggtgactacttagtgctagacactgttttagatacttgggctataacagtgaaaagaacagtaattgaattaatgaaaagttcattttaattagctgtatggtaaaataggaaactaacaaaaataaaatataacatgtcaaatggcaatgactgctctgagaaaaataaaggagaataagaggttctaaattattatatacggccaatattaccaacatattatagaaagaaatgagttcataatgtttatcagagaattccatgaaaatcgctaaatttttctagaaagccaggcactgataagagaataaacaaacagataactgattttaatttgatcttctcttacaggtgcagctatgatctgccattgtatataatataaaattaaaaattgtttatatttcattcacgttagcatataatgttcttacttttttttttttttgagacggagtcttgctctgtcacctaggttgaagcacagtggcacggtctcagctcactacaacctccacttcccgggttcaagtgattctcctgctccagcctcccaagtagctgggactacaggcaggcaccaccaagcctggctaatttttgtattttattagagacggggtttcaccaaattggccaggctggttttgaactcctgacctcagatgatctgcctgtgcctcggactccaatagtgctgggattacaggcgtgagccacagtgcccggccaacgtttttacatttaaatatcagacatctatcatattcctttctccctactacaaacattgtatgcttttcaataggcataagattttgttttcactcaggttggattcaacaggtattatttagcagttcattgcatctatccatttacccaatagaggaagtatacaagatacaaatgaataaagtgtaataattcttatactatttgcccttatgtcatgtaactgctccatgtttgtattccgaaaacctaactgggagggaaaactcagaaaaatagaataaaaagtattatatatctcatacatcctcatttttgaatattctaggggtacagatcagtataaataaaatactctggtaagtgaccaccacatcatctgtttgtcattcttagacccagagtataccattcttttaagaaagaaaacttgctactgtacctgctacccagtaacatatatatcacatatcatatatatatcataacatatatatcatatatcatatatacacatatcatatatctcatatatataacatatttgctactggttaggagtaacactcagaaaattatacttaataatgtagtacaattaggtataaattcacttagtatttttaaattttacgtatattcctatttatatgaatcgtcatttaaaatcacatctactgatcctgatagcattaaaggcataagaggtactgaggatattaatttaattttgtttacagctatgcacagatatttttagttcactgagatttaatccagtagtctattatttgattaattgtacagctatcaaatcattcaggactcccactgtttcaacaacgagagtggaaaaatattttttcatttatgtttatatgcagctatttgtagtctaaattaatatcctagcaattgatggtgaaattaaaattatttctgtcagatgtggtactttgatgacagtggataagcatgggaataaaagaaagttttgaggaagaggggacagtttttgtttacttaatgattattccaaagatgttaagtaaacattctatagaatgcaacatatagtggaatacagcattgaaacaatttaataatgtagtcaatgaatccagtttttagaaatgggatccattttctaaaactgagcatacagatacttcatgagatgctttatcactcatcctaaaccaaaccaactccttcccttgactgtcttgcagtgcatagggcatctctacactctaggaaaggaattatcaatctgtttatatgccacttataaaatcatacttaatgtacgattaggcataaatttacttgcatttttaaattttgtaaaatgttaacggaaagtgttcttgaaaaacatttctgagaattccaaaaaatgaacaaattttaatacataagggacaatatctttctagtgaattgattatcagagtgtaatgtggtatgttctgattatgttacataatattctgattagcagaaaattttgaataagtgaatttagcaaaatgtttagaggtcaagaaaactgttttagactgactatgttttctgacccaaatgtaagaaagaacccaataaaaagaggcagccagataatgctgttgtttgcaaacttaaacagaagcttgcatgtaatttatgactcaaagaaaaataaaaatagaagttatactttatttagaacttaatgacagtgaaaaattgcacataaaaaggaagactgttgaatacagcaaaagctggaattatataagaaatataaacataaacacacaaaataagtgtaaattataatgaagtaaaaatatatcaaagagaaagaaggaagcagtacaataaaaaataaagttgattctttaaaaaccatagttaaatagacaaatttccagccagattgtttaccaagtaaagagaaaaagaaggagatagatcaaaagacacaagatgatgatgaaaagagggtcagcacttataaacatagtagaaatttaagccataatgagcacaagaaagcattatcaacttacttttgaatatataaaatagacacttaaaaaactgaacaaaaatgacttactagttttaaaagaaaaaaaaaacatcaaacatctatccttccaaaagtatagacttcaaaagtatagtcccagaagggtgaacataaaccacactttaagcaagaactctcagttataaccagatgggtgaacataaaccacactttaagcaagaactctcagttataaccagatgggtgaacataaaccacactttaagcaagaactctcagttataaccagatgggtgaacataaaccacactttaagcaagaactctcagttataaccacatgggtgaacataaaccacactttaagcaagaactctcagttataaccagatgggtgaacataaaccacactttaagcaagaactctcagttataaccagatgggtgaacataaaccacactttaagcaagaactctcagttataactgcttgcagttttagaggatcccagccacactcctgaaccagagcttggcactgggtattccctctggaacacccttttatttccttctctaagcaaagacatggaatcaacctaaatgcccatcagtggtctgctggataaagaaaatgtggtatataaacaccatggaatactatgcagacataaaaaaagaacaagatcttgttctttgcagggatgtggatgtagttagagaccattatccttagcaaactaacacaggaacagaagatcaaacactgcatgttctcactcataggtgggagctaaatgatgagaacacacggacacatagagtgggggacaacacacactggggccttttggagggtggagaattggaggagggagaagatacaaaagaataactagtggttactaggcttaatactggggtgatgaaataatctgtacaacaaaccaccatgatacaagtttacctatgtaatgaacctgcacttgtacccctgaacttaaaagttaaaaatgaatgaagcctgtcagaaccacccatttagcagtctaacattttgcctagtattcccaaatccctttgcctagccaacatttttcacagcactttttgtcttcaaactactggcctgaagcaatctggcttagctttctgagtagctggaattgcaggtgtaccagtgtgcccagccacagttttttcaagacctgtttaagacaacaggttagagaaaatcaagataatattttgagggggaagaaggtaaaatcaattaagacagggtgcacagagtacttgaatggtacagataatgtttatcctttgtactaaatggtgtgtatgtgggaattggttatattattttgactgtttgtagtcatattatatacatatgtgtataaataaaaataaaagaaaaaatataagctaaatttatagatatattaattttatttaaatataacaaagatttgccagtattcaaatgtctgcaatgattcttaaaatgcacagaacctgtgtttaggtacagtatcactgttcatccagccttcattcactcgaatctactcttacctaaaatttgtaccgtaagtaaattacattctgtatgacagaaagcaaattacaatattagaacaacattatggaaaattggcataacattgtacaatcatccattactttattatttatcattttgcaaatttttattatattagtaaaaaagtctaactgtacttaatagctaatacatatattatttgatatttttaaagaccattattaaaataataataatttgggggtgagaaggcctattgaaaaatgaccaacgtggaaatcataaataagtttgatgcaacaaatatttgtgagtcttatagttaaaaatgtaaaaattcattataaacaaagctaaaagacaataatatgcattgggaaatatttgcaacatttacttcaaaggtggatgtccttaagagaatttttacaaattaataaacatttaaaaaggtgaggagtggcaatagctatgagagacaatttacaaaaacataaaaaatatgaaaactgtttaatctgtaagtacatcaataaaaattttattattgtagttattttatctattaaattaggaaaggtcaatacaattggtaatcttccaagtaaatataggagagaaggtctttctcatacatttataagaatattattttgttagaatgcaattaaataaacacttggtaaaaatccatatcctttgtccaaacaatttaagttctagacctctagaatccacatgtacatatacatatatacatacatatacacacacacattcacacctatatattaacaactcaaatccaactccaactcttttgtaagtagtattttgtccaacaaataaatttatctcaaattcttcttgacttttctccattatagagccagcaattctacgtgtaactctacctctaattcctttatttgcatttatttctgctttcaaacccttatatgaggcaagtgggattaatttatttcattaccttaactagattcatcgctttactttgtcaaactctgattgatttgctcaactcaatcttatgtgttcaagaacttaatgtggattcctgttccaccttatgaaagtcttttccaaaaacttgctaaattcttgactcaagacattgcagtcagtaatgcatttctctcctcaaatacaatggaactgtgttctaataaatactcttcaacaatgtgcagttatttctccacaactatcaattccccttaaagcagaattttactaaaaatggctttatccttctggggataatcagtaaaatggcaattggtgggtgaattaaaaatatactaaaagcagatggcagaacatgagtgcagatttttactacaaagcttaggaaaagcaaaaggaacttgaatagagaaaatgcagaaaagccctcctttggctattaggacggagagagcagaagtatgtttagagcttcaaagagtctgactctttgcaactgtttatcttaggactttaaggaagtaaaaggtgcaagtgaaacactctggattataaaatagaatctgacacagaggattcaacccagttaatatgcatgttgcttacatggaaatgctgagaaatttttagcaaatagatagaaaatgacagatggtaggtatatagaaaataattgtaggaaaaaatgtaaaatgaagatttatggtattccttttatattttattttgttaatatgttgcccataatgctttatttcaaagaatgcaaaaccaaaaaagtagttccttcctaacttcccctgcagccttgtcttgtggagcttgtattttacttcatgagaaatgccaaggagatgtcatttaagctgaaacctccagcagaattagccacaatatttgggaaaaagatgtttccagaaaaagaaagagctagtataaatgtccttaggcaagaaagagctcacgatgattgaggaacaacaacaaaaaagattatttcactcaagaaaagtgaattgggagtacagatacaaatgatgaggtctgaatatgattcatggggcaggtcacactagggtgtttgggtatggtctaaatgaatgcgcggcatgagttgctttaaggagaggagtgacatgatttgacaagttcttaagagatccctttgattactctggggagaatagaacataaagtagcagaaatgaaagcaaagggagatagtaggaaataattgcacatttataagcaagaaatgatgttggcttggactctggttatagcaacaaataaagaaaaaaggaaatactgagaagagttgattggatttgctgacattctcaacataaatggaagtcagtatttttttctaataaatataatatgcgtaaatatttttaaatatttaattcttttaccactaatggggcacgagtagacttcagggaacatgccagtacagaaccatataaatgtgatcattggtagagataggaattaataggcatttgaatgtctccctcaacctggaataccacaaataaagctctttgcttttcatgttgcattgttatcataccctatagttttctgccattttcagttacttaatattatgttttgcctcaatagattatagtgctttctcttgttgtgttatatttgcagcaattattagtgaagttttaaacttcaatatcacatctaaaacagagcaaaattgttgcatactattttccattaaaacatgagaccactatgacaaaaaaagctaaacgtgtcatgaaatgacttacattggatgaaagtatatgcaatatattaagaaataatctctgactttatagttttttatttgtagtttttactagaacgtgaaatcaatatgtgaaccctggctggagtttgcatctaaatgtaataaaataaaagaaagtttaatattatcattgaagcattaatgtacattagcgagctggactatataaaataaactttattatatttagcatttgatttttatttatgtatattataaaatgaatatagtttatattataataaaaataaaagaagtagtatgttaactaattagtataagatgcctacaaactacatatctgcctaaatttttgacccatgaaacttcaatgatttgtgttaatgttaaggcctacatttatttatatatatatataattaggggaggaattgttaattctttcattttaaaaattttaactttgcagacaaagttgactatacctgtggcagaacactgcaacagctataaataaataaataaataaataaataaataaataaataacttttattttctgtggagctcccagaattatgaattattctgtagattgagatttgccaaggtccttttcttagagttgcaagagcataggagaaagtcaagggaaataataagcagcacttgatttcctttaccacagtggatgggcttctaaaaccaaattacctgactataaatccagatctatcttctgcaggctatgtgattgtggatgttacctcttctgtgcttcaatttcctcatctgtaaaatggaattatagcctaccctattttgtagtatagtgaggataaatagaatgaatgtatgtagttcttagaatagagcatggcacgtgataagtggtcaataaaatattgtttactactagttatgtaacagtcacttcacacataataatgatttaataaaggaataagaagaatgtagagcacagcttctcaacattggcactatgacattttgggtcagacaattatttaatgcagagggggctataggatgcttagcagtgtctctggccagtagtgtacctcctcctctccaagttttgacaatcacaaaggcttctagacattgacaactatcccctgaaaagtaaaattgtccctgcttgagaacacaaatataaagtaaccactcaaagattacattactaattttaattgaatttgaccagcattatgaaataagcataagcttaagtttctacccttgattttgtcattgtcagttagggcagcagagaactccaattctgaaaattctgaacatgtgctaataccctataatataatcaaaactttcatttttgaattgtatttcttaaaaattagaaaatttattaagcagcaacatggaataattaaccacaaaaatgttgaacataaatctcatttgcctaagttctcttttgaagtcctgtttcactatataagtattatgtgttttgtttcacagctagataacagccagttttttctctgagcctaaggttgctcctcaaatttatggtggcttatagctcttctaagtttctataaaacttcagcaacctgcagcaggttgaaatttattgatattgagttattcaccaggtcatattacaaagtcagggactgactcacccaaaccagatgctccccctgccaccagatcactaggagatattgcaatcatttcccctggctactaaattagcaaaaattctcagggagagagaagggcaagatggcacagtttaatacttactattattcttttattctttatcatcattccctttgaatggattaagaatctgacataaatataacttgctaaagaaagggtgttaggtgagagggaagtcatattggtctaagaaaagtcttagagaaatatttgaaaagaggtagagagaagggttggattggagtgggtgggtggggaatcacactaaggagatggatcattcataatttctttagacatggtgaggcagccacaggagtctgaacttgttgaaaccctagtctgaagccaataaaagtgctcaataaggtcacactttgatcttctctgcctaaagcagttattcaccctatctttgggagaggaaacatctacaaacctttgttctctttgttagcagagggatgacatgaatttgggaaaaacgtttgagagacaaaatgagatttagctcgagcaagtgatcgacttgtgctgggttgcaaatggactttttcaacaggcaggttgaaactgtgcttcagcaattaggataccagatataaacatccatgcacagaattggaaaggttcagctttcatggttgctatggtttgaatgttccctccaaaactcatgttgaaacttaatccaaaatatgacaatatagagaacgagctttttaaagaggggattggatcatgaaagttcttccctcatgagtggattaatccattgataagtcagtggattaataggttatcttgggagggaaaccattagatttataagaaggggaagatagacctgagctagcatgttagcatactcagccctcttgccatatgataccctgtgctaccttgggactcttctgagagtccccacaagcaagaaggctctcaaaagatatgccccatcgaccttggatttccaagccttcttagctgtagaaaataaattcagttctttgtaaattactcagttttaggtatactgctataagcaacagaaaatggactaagacaatggtcttatccagaactttgtaaactagaattggctgtttagattcagtatgtattttttttatagattcaaaataattttgttttgaactgtacaatgaaggagtgtcataagcttttccacatgtagaggctctaaatatcagtctggcattgtgataaagcagagagtttaaacccaatcctatttgtgccccatgaccgttctttctggttacagttcagaaaagtaggaatggatgtgtaactcaaggagaagcatacaatacatgaagctttttctcaaaattttgatttagaaaatgaggtattttagtatgttaattataggcatctcaactgagaagtctaatagcattgggccagaattgtcgcagcagtccaaagccatggataaacttaagttaaagggagcaaatactaacagccttccaaattaatctgtattggagaagatgataaacagatgaatgggaactagaaaccatgcagacttggaactagatataaaacaaacagctatctaatgatttcttatttactctgagcccaagatatttttgtatccttttagttaaacctctgttttactaaggaaatttaaataagattctgtctcttgcaagaaaataacatctaagacatcttcgtatttaatactgccttaattttgtttactccagtggtccccaacctctttggtaccagggattcgtttcgtggaagacaatatttccatggacagggttggggggaaggtttcgggataaaactgctccactactcagatcatcaagcactagattctcacaaggatcaaactagatcacttgcatgcgcagttcacagtagagctggtgcttctgtgagaatcaaatgctgccaatgatctgataggaggctgagctcaggagtaatgctcactcatccacctctcccattctgctgtgtggcccagttcctaacaggcccggtaccagtttgtggcccaggggttgggacccctgttttacactataacatttccacacgtctctcatggcctttcagatccactgcttgtctcaactcaagtccagctacctgaaaattcgattattttttcaaagtgaatttgaatatctttatgttgaatacacagtctccacttttacgcagcccctactgtcttctatcatacctctctagccctggaagagatcaactttacattcacttttcctgttttagggctattattttatcttcaattaccaaaatctatctacatttagatactttaacttgcaaatacatagtaaacaattacagattatttaaaatagcagttttcccatgagtataaaaaaaaagaacaataaaagcaatatttgttgagtattttaaagtgccaggcactgagcagtgtgctttgcttaagtaaatgtttgacaaaataaaaggtcctttaaaagttccatgctttaacattaataaccatataaagataaggttagacttcctatcaaattagcagttttgtgaagataggccttttctgctatatagaatctcctcaaacctgagtgttcgtattatggattatctagtatactccatagctatcaagtttgtgtatgtttctttctcaagcaagttatcttatttctccttatttcttcagacttatcctttcttttcttttcttttcttttttctttttttttgagacagagttgcactcttgttgcctaggctggagtgcaatggcatgatctcggctcatcacaacctctgcctcccgggttcaagtgattctcctgcctcagcctcccgagtagctgggattacgggtatgtgccaccacgtccagctaattttgtatttttagtagagacggggtttctccatgttggtcaggctagtctcgaactccgcccgcctcagcctcccaaagtgctgggattacaggcatgagccaccgagcctggcccctaacctctcatttctaaggaaatgacaaattaagtcttttatgcaaatacagtgtagggtcatttaaaaatattttttgtaataggtgtctctgtacataaatctatttaattttttctcttttacagtaaaaaaggcaatactgtgttttagtttcaccaaaaatttcagtagaccaattgtgtaaagggatacatttatatgaatttttttgacatagtaaaaactaagaggggaagttattcaaatatttcagcataaattccctttccttgaaattgcaatcgtcatgtgtagctacaattcctcagcattcctctgtagtataagtagctacaattcctcagtataagaaacactaaggtggaaaattaattgttaagagaacaaagtcataacaaaacaacaaaacaaaaaagtaggatatagaaacattaactcaatatcactcttgaagctcacataagagaaattattgtactagacactgtggttcatcatccagaccccatcttcatgggaagacatcgatcccacactcatggggaacatcagcagctgacaattcacacctgtacctttcactaaatattgtcctaagacaaactaaaatgaactaactcgcccaaagtggtgcctcctttcagagagcagccattgacccatggctggctaatgtagttatacaaacatgcaactgctttgcatcaatttgggacaactctgaaagaggcccagtaggattggctgaagactcagttcaaagttgtcaaataaagcacaccatgcccagctgaatttacattgtttactatgagtatatcccacgaaatatttaggaattacatatactaaacattattcatgatttatatgaaatttaaattcaactgggcaacttgtacttttacttggtaaatctgggagcttttccttagttgcatctgcatggcaggtaagcatgtcggtatgcccagacctcccttctttgcttccttataagtgcgtcccagaaaacaagcaatcatctcagagccaataggcattgaggcttttgataatcaaactcccaaaggtcaaggaaaaagagagtatcccaaaagcaccaagagaacaaacaaacacataacatacaatggagcttcagtatatctggcagcagacttttcagtggaaaccttacagccaggagagggtgacatgacacatttgaagtgctgtttatgggtcccttcggattgtaacggggaaaacaagaattgtagcaggaagaattaaaagaaaagagagaagctttttttttttttaataatctgatctttttctattgagaggcaggcacccaaatgctgcttctgtcggggagtgaatctgtaaattctttgtaactctgtgctacctatttgttaacctgtgtaatttgttctcctgctgacttcttgcaaacacttgccagtgggtatctgaagcctcttacatcttctgtggcacggacttggcctatatttagcatattcactcatctaaagtgggaagaagaatctggcatcttttctctttctccatcttgccatcaaaagctgcctcaatgagcatgtagccttcagaattttgaaagcaagaagcaggcaacaactggccatgtttagcttcatcttgaaactcttgaggacacctatcaaactttcccaaaactgtctcatcatgtatggttccattgcaggatgggtgcaatgctgagtgccagaaggagagggatatcccattctttccttcttaaaaattgctcccagtctttttgagctctcttcctgtttggaaggagaactaaagcaagtttagttctccttacaaaagagaaaataattaaaagcactctcacttaggtaactaattcactttctatatgataattcttagaatgtctagtcctctctttacataagagtacaggtaattgaggtcagtgaaggttttagttacagaactggtctggctactttttattaaaacctgcaaagacttaactgttcttctataatttagggatactcatcatttaatagggaataaacaaaaatttgagacaaaaggaaattctgtatccatttcatatatatacatgtaaattacatatagaaaaaatggtttagaagaggagttaatatcaatttaaaaacgggaattttaaagctgggaataatacatagcataaatatgtataaggattcagcaaaatgttagttgaaacagggggctaaataaacttgaagtttaagaaagttaagaaatgaacccaaatatgcataaatctgaggacaaaatttgatattgctgctaataaacaagggaggggcatcatattgggaggcttcattaataaaagtaacaaattatgagaacaaatagtcttgttatagtttatctggtgaagcattttaatgaggcatagctgtctgttccattaccgaacgacttttcttatgtgtgctctggtagattttcatatggctacactgaaagatattcccaaatgtctgactaataactctatctataggcaactgttctgaaggtttaaagtaaggaggatggggttcatttagaaccagtgggaaaaaatgctaatgctgggctttgaattttatggatgctgtagctgttatttttcaattaaataaatgttttatatgccatgttttgtagctatcgcagttaaactgccctcatctttttgcccagcaaaaaacccattaagatcttcactgagattgagtctaggtttttataaaattaataactttgctactggtttctcaaaaatgagtagaaatgacttttcaatgcaaatgccagtttttgatacagtgaaattatcctgtctgcagtgactatttgaacttttatcggcaattggacactgagagacttagtatatgaacagatttatccttagattatctaatacatgctttgcaccctgcaccataaaacccgatctatttttaaagccttggttgttctgaaaaatgaaatgaaattgtattaaatggcattttgactggggagaaaaaaaaaaacttcatgtggtttaagagaatggatgccggcaattgactgtctactgtttattcaaaacttatagattagcagccagatgtggcagaaagttggctgatttttcattcacaacaaaaacgatgctgtgcttaatgaatggaggtttgttatcccagtaataagtaaaaggaacatgaaagcccttgtgtttaatgttcatgcaaataagctatttgcaggtggcttttgggcagggtcaagtattttcaaatatttttcaaaactgggtcaagttttttaattgtcaaaaattaccagctagaggaaaacctcctaaaaactttattatgctatttcccaagtaaatgaaatgacaagtcacttatcatttaaaaattacatatgaaaattcttttccttatgatttcgtcaataaataaattctagaggattctagatatatttatttggcatttttttttaatgtggtatcaaattttgtggacattctttagagaatcaaattcttaaaatggcattgaacatttaatttaaaatgtccttcttgaaccatacatgtttattaaaaaattattttatataggttatccattaaaaaacaattttctatatatgtaaacatttatgataactgctcattattttggtccatacttatttatctacctatttattaaacaatacaaatcatacgctttgtaaaaataaaggcctagtctaatattactctctgtcagaaataaaataattcagagaagtctgtattagaagacaaaataaaacaaaacagaaaatgatgagaatcacaaaaccattgccaaatttccagctatggcatttactctccatgtggccttaggtatcttactctcttattttaacctttctttgattactgtaaaaataatttgttactaagaaaccctcttgctttagtagctgtgagtataaaattaagaacataattctcaaaaagtgttttagtcttcctggaaacattttaaaatatcaattaatcattgaacaatacacaatcgcctgatcatttgctaagagagggttgcattctcatctctgttcacttctgtcctttctgagacttacacaggtatgagagctagaaaaaatattaatgtgtagtaattcaaaatttctcattcatgaatcacttcagcagtgcaaagaatactttgtaatttttaaaaggcatttttattaatatacttctactattctaccccaatcaacagcaaatttacctaaatcatgagactactggtacttctaatttttagaaaagaatgacataaactgctaataaacccaatgaatcctttacccgcaatgagaatgtccacgagtcagctcttctgaccctctggccagtgttctggagttactgatctccaactttctaattgaactctagcttggtatgtgagagcagccatgggtgaaccagtggagcaagatttaagccttgacattgccattaatgattcaccacctgttgcaagttcaataagttattcacacaccaaattgtggccgcaaaattctgggagataaactaagttagaaagattgggggtgaataaatgtttgctaaatcagaattgttaatgatagaaatctgtatcttaacaaagttgagaaatcttgtcttcttaacgtgtatttattgacttcccaggatatgtcttagtgaggaaacatagcttctggcatttattattagagtgataaggaataataaaccacagtgcttgagagacagggaaaggcagggggagccagagacacagtaacagaagcagattaattgactgatgaaataaacttgagataagagagcacagaggaggttcaagagatggaaccatatattcctctctatctgctcccaacatcaaggaaattcatagcatattttataatgaatccctgataaatattagtctataattgaaaatctattaaaatgactatttcttagggtacacaaaaatattacaacaaaacaagtaaagaaaagttgccatgggatggaatattatattttcctgcatgtctgcttcaaggcagaatcctaatggtcatgtatgtaggtaaattattctttttacagcaacttctgggaggtggtatttggtgcagtataaaaggcaaggggtgtagtgagggtaaagcgtaagtactttgatcttgagccttgactatattggacttgggatctcggaaatcttggggataagcagtggattaaatccataaattagtaaagtgttgattatacaacaggtagaactacgtgccacttttggagggacagtcttcttttttaaaaaaaacaaaaggccttaaaggctttatgtatatataaagccttttttaattataataaatacatttttttaatgaaacaatctgcacatatacaattccactctcaagaaaggcaattatttacataattatgcagaaattcctataattatgaaaataattgcctttcttcagagtggagttgtatatgtgcagattgtttcattttaagaaaagaaatatttactgatttgattaactgaagttctggatgcttaaaaaatgattaaaatacacagatctactatctgtcttcatgaactttaaatgtcttgtaagaaattcaagtaataaagactacaacatttattatttaactggaacatgtattatttattatcctaactgtggttaggaagcaccattatttattatatctatattaatcaagttgtatcctgtaacaggtttcctgttatccactcatgtcttctaacttctgaagtattgtttaaattacaagggagaaacctagacactacattttctaggatctcaggacaatagagctccaggtgaaattatgctaaataagggcatgagtgtaagatgtggatgtcacagtgaagagatttagagcatttttctggtgacctcctgtttaggtttgacaagcatctaaaatcattgttagcaactttcccataattattgcattttcagcctttatgaaaatagcagcattttttttcctttctttgcccatgcacaccatctaatcatgagataagtctccttctgagtccctaaatacatgacatacatagattgggatctttttctgacctgttcctgtctgatacattcttcaactctaagatgagttcatactcatcttctgaagcccctgggaaatggaaatattttttcatattggatgttggtagagacccatcatttaatgaacatttatgtgccaggatttgtacaagacacttagatacattattcatgtacctcacacaaatgtatcaacaacacaacaaaatgtctgtatgaaataataattattatatcccttatatggaaacagatccagagaggaagatacactagcatgtgtaaatagaggattcaagtattaaacatccatctgtccaactgactacaacctctttcataaaatgctaatttctctcctgcttctaattttcttatcaaaaattgtcatctattgttattgggtctatgggtgggtagtgactccttggtttccattttgttctagcggattactgtcttctttatttttgttctagtgtttattgagagtcctaattaattaacctggctgctctgacttccatcagctcaccattgtctcttctcccagctcataatttctgtaacagagctctaggctatgctgaagttctgctatatgttgccagtctctctagatccaagtgcctcttgtcggccaagtttacatgcacgtgtttaaaatcttcttattgactctatatacaaagtcttcacatgccttcctccttaaaataatagcattgtgagaagaaaaaaaaaatcatcattctttttaaaactaattcaggatgtctatgttatacaacaacaagacgtgggggaatatttacctggtagttctgtccctcgttatcattctcactcattataaaattggtatctgaaaaaaatcttgctgcaaaaacaaaaaaaaaatgtatagggtataaagaaaaagtttgcttcacatcataaccattacccatcccattgccaaagggaagattgtacactacatgattccggggagcagcattcacatagactatagtgtgcatggtacatgcaagagaccccatagtactacccgctttgtcctccttgtagacatgctcacagatgatccatgctccctgacctggagtagtcaaataaaagagtagcatcaatttattaagattctttccagaccattttctaggtattcccattatatattccttcaaatggaaggattttattctgtacatcacatctcactgtacacatttttttctgaaatctgaaatctgagtattttaattttatacagtttcaattgtgagaagtacctgacagactgacctgacctaacactctctaagctaaaacactcataaactagcatagaagctttacacatttatccatttctctaatttacttatctattgtttcctgaaacatctattaatcttgcagttatttgagatgactgtgagcttactatttgccagggatggcatgagcaccttggtttagtctagtgcctggcatttattttcctaaactgtggcagcaagtttagctgtaagcatattttttatcagaacaatcatccatctttaactacatgtgaggaaagtactttcttatattgcattacacatttttatatggccacagaaatccttacttagtctgacaaaattatggtagatttctttctcctaaggtcaaggaaagaatcattctgtactgtttccatggagatgtttctccttttctcaattgccaattgtctactgtgtgtcctgggttccttcttttcatatgtcatgaggattctcaccccagcattctgctcctctgagtcaaagcccttgactttcacttctcaattgttttgtttgcagtttttttgctttcctttatttttcttactctataaatgctatgaaagtgtatgtaaaaatttacccatcttttagtttatatttgttatcaccctttattcatataccaaaccatataggaaatgaatataaggagatctttcttagtaggaggtagaagtaaaattttgtttagaataaaaacagaaaaaaagagaataaaattccatatcaccagtttgcttctaaatgcccaatgtttccacttatgagcttgctactgtacacaacgcaagggcttgtaaaaaattgtctaaatgatagtggttaaggacgtattttaggctaggttactttaaaaaaatatatcatcacttctgccgtcaaaagtgaatttgatgtatcataattgttaaagttgaggagggtcaaggattcttctcattctatggtttccttataaatacactttctaataaatgcctaatttttttctgtgaaattaaaccattagatattgctgaatgtctgtatgtttcttacttttctagaatctcattcttaattatagttttatatttttccttcaacaaagtcttaaaacccatgcagctggtgtctattatttacattctgtgatgtattttatttgactttgtgtttttagtcttttcacagaaatccttttattgtgatcttcttgtccaaaagcacttatttcatatctcttttccatacctatcttcattagcaggttgcatttcagtttcttcagtccttttttagataatatattttactacatctgtcttcacaacactgtatacgctctgatgatcaggtctcccttcttttttttttttaaattctcgtcctctttgggacccgtgacaaagtaaaaggcagatttttttctcacctgacttaaaagtaaaaaggtggccgggcgcagtggctgatgcctgtgattccagcactttgggaggctgagaagggcggatcgcgaggtcaggagatcgagaccatcctggctaacatggtgaaacccgttctctactaaaaatacaaaaaaaaaaaattagccgggcatggtggcgggcgcctgtagtcccagctactcgggaggctgaggcaggagaatggcgtgaacccaggaggcagagcttgcagtgagccgagatcgcgccactgcactccagcctgggagacagagtgagactccatctcaaaaaaaaaaaaaaaaaaaaaaaaaaaaaaagaagtaaaaaggcttcatatgtttctcctctgattcttcttaggcccagcatttccaaaaacaaaatagtacacaaaacattagttgtaatgatacttcaaaaggttcaaatactagtttttggctgctttctgactatatttttcttctaaagaaattttgttatgaagtattgaactattcagtatactttaatattttccaaataaagtttccaaactgatatttaacaatattctcttatattcaaacatattctgaactattttctgctgtgtctctagatcaatatttataaatctagattgttcatgtattttttttcctttgctaactttcaagatcatatcaaaaagcaccactgttgattccattttttatgtttcattatttgaaactatattgacatttttcctcttctttatcattccctgttatctcatctttgtgagtcttccaattaatgttttttcctttgaattatttattttttaactgaaaataaattgtatatatttaaggtgtaccacatgatgtcttaaagtatacatacattgtggaatggctaaatcaagctaaacatacgcattatatgcattaccttgtaatcggaccccttgaggtgtcaatacctcagcatttttagtgattgagataacaaaaattcgaattaggcccttgcttgcttgcataaaagccaacatcccttgttctcacaatacaattgcaaactgctgatttactatttctttgtcaaccaggagaagataactttaaggtaacaaaaaacatttgcagaaggaatgaatgcctataaggatgttgcaactaactgctgaggcccagaagtctggttgctcaggatattatcagagattaaagaaacacagactttccccttggttccctaaaactccccctctcttactgtctagctgcaaaaatatcctctctgcatttttttttttttttttttttttttttgagacggagtctcgctctgtggcccaggctgcagtgcagtggcgcgatctcggctcactgcaacctccgcctcccaggttcacgccattctcctgcctcagcctccctagtagctgggactacaggcgcccgccaccatgcctggctaattttttgtatttttagtagagacggggtttcaccgtgttagccgggatggtctccatctcctgacctcgtaatccgcccgcctcggtctcccaaagtgctgggattacaggcgtgagccaccgcacccggccccctctgcttcgtcttattgttaagacatgtctgagagatcttgccccgttctcactttggccaaatggaataaacttttatctatccccaagcattggtgtgtcagtgtttggtttcaattgagcatcaggtacatgagcccgaatttgggcctctacaacatcttcacctacttactatattttgtgtgtgtggtgagaatacttaaaatctactctattggcaattttcaaatataaatgtattgttattcaccgtagccaccatgatgtgcaatcaattttttgaacttactcctcctggctaactggaattgtgtgtcttttgaccgacatctctgcaatttccccatgccctagcttctgatgactaccaattaactgtctgtttctatgagttttacttatctaaactctctatataagtgagattatgtcatagttgtttttaagtgcctggcttatttcacttgatgtaaagtctcccaggttcatccgtgttgttgcagaagatttcttccctttttaaagcccattaaccttttatagatctggtactgaggcaatgcaagcttattggacaattatatgttatttgaataaattgaaacataacagcttataaagggtcaaatggcagttaatagcctaagaaataggtttggaatattatttcttagcataaaggataatattggtcagagtcttctaggcttgaattcttggctacttagattttatcaagtaaattgtaaaaggatagtcaatcacttttttcacatgaattgctgtatgaatttcgacttgacaagaaagactgtgaaaacaaaaccactattatctgtgaactacctaatgtggaaagaaatatccttaaataaaactttgagaaagtagattactcaattttttcctacagatatcccatatattgtaactaattataatatttaattgaatacaaaatctttcttcttaaggaaagattttattcagttttagaacgttaaagtttctccactctaatatatacagaacttctttaacctttaaaaatattgcttcacttattactcatgataattgggccacatacataattaaaacacaccatttattatttccccttgtaaaagtggcatctggttccccaacttaacttcaaactgtaattttaaacaaataataaagtgttttgaaacattaatgtggttaattgtcttatctattgtctatgttcatcaggagctgtgacatgcccaaaggaaggtaatcagaggaaggaagagaagaagctaagttctagagaatccattaatcatggtttagatgactgaccattttattattttcattttccatttaaaaacgttccatttttaaattggaagggggtatgttttagaatagaataacgaaattccctccatctcctcgtagtgtacgtgattaagaagaacctaacagaaacataaggttctaaggttcttgctggaaataataatcagaactgtaagaattctcttatagaaaacatttaaaaaaggaaattctagcaatagaattcattgttaaaactgtaagtcacaacaatattgtctctgcatgctgactgtactcctctgtaatcttcaaaggcaaacaggaacagtaataatcttttcatgtactctcaacttccttctctgaaaggctagaaaatgtcttatatgtagcactcatactgtcatttaatcaaacccagtttctatttttcttcaatttctagaggaatggctacttagtctttctggcataatgtgaatttcttaagtgtctgtagactacatctcctatttttacttcttgaagtttctctcaaactgtgataaagagtgtcactctatcggtactgttaataatgtaaattttgtttctctttttgttactgccaagattccactgactgttgaaatataaaagaaaaacagcattaaatcaggtgtgataaaatcacctttttctgtttatctccaccactggcatttattggcacttggaaactatttataaactcatactcttgtaacagtcttgtagctgaaacccactggattcaaaatctattcctagtacttaactttcttctgaaaattccctcatctataaatttgaggatgatgataattgcaaagatgccagggaaatttataatcattactgaactaatccttttgaaaatataaagcagcattaaatgttacgattactaatctttttaattaaagtggcaaatgtgtccaaaaatctgtaactaagttcattactctcatttatgcagctaaacttaagttctaccaaatgtatttttaagttgattaaaaatatggttggcagcatttataaatacccattattaacatgctatactggtaaatatatttctgctcttatgactagagagtgttgtactttagtaaaaaaattatacctcaataattatctgctctcctatttttattttatttgcaatagatatgtatttattcatgcatttgtattcttattgaatgaaggatgttatgtcacttgcattgagtacataggcatccctttcgacaaataaaatcagaatctaaactacagaaccaggttcaagtggggacagaagtacaattttaataaaggtcaaagttttgctagtgtttcacttaaaatttatttttaggctttctgaatgttctcttaaagaaaaagacttaatcatatacgtacttttttgtattgttaacaaggaagaaacatactaatatgaatggtactacatacattatacatgttatacaagagaagaaaattatatattcaagataaacatttttataatcacaatacttcaacataaatgtgttcaatatagtaaagatgcaggttgtataatttgtcaagcaaattctcaattatgtttgaattctatttaaaatcaacattagtattgacaatattcatatttaaggctttttaattatttaaataggttcaagtttgctgtgttcagcattattagttgtaaaagtaggctctggtaccgaaaatatatatttttagctcccttctgtcagtctttccattaaatgctatagactcacagttttacatgcttctcagcacctcactgctcttgttgcctataatattttattagtttaatccttctgaaataatcctggtcattcaaaaccaatacatcaaaatcttctagagtgaacaaaagaaaaaacttttgtgaagattaaaagaaaaaggagacttctcagatatattaactttaaagactatatctcacaattatgtaatatatttgttgctttatctaattagatttgcatttcttatatataccatgcatataaaaatatatttgatacaaattataatacaaggcatacaaaaatagaccattataataacagaacattttctaaagggattttaaaactgtaagccaaatgccttaatctaatactacttctaaaatgtattctaaagaaataatcttgcatgtgtggttagacttaattacagaaatattcattgtaacctttctttagaagtgaatattgaaaactgaaataaatctaaatgtccaactttataattgctagttatggaatactaacaaatgaaatccatgcttttaaaatagcatttagtgaagcaaatatatgttcaaaatacatataaaggaaaaactggtatgttattaaagaagatagaataaaatttattttgagagtgtatgctaataagacagttttgatatttaggaaaattaaaatgttaggtaatattttaaataaaaaaataaattttctgtttgctgagattatacgtattttaaacaatttttaatgtacgctatagacactgaacatgtataatttatgtatcaagaaaaaaatcaataagttcaatttttaaaatcaaaattaaaagtcacataatagatcagagaagataaagatgaattacacttttttctttatctaacaaaagagagtgcatggtttatggagacagacaatttttttctctggttttaactctaagatataaaaggaatctattgtatacatctggaaataagaggtatttaatacctaatgtatattaagattactgttttagctttttttttacaatatagaagtactgtgtgatgacttaccttatcaaccattgaaagagccattttcaaagattgattaaaatcgaagagttccataagcaattttcactaaagcattgaaaactattatccaagattaagaaaatacttttctagggatccctcatatctagggatctaatgaccattagatccaccttgtataatggaattaggacaacccaaagatctggatgattgaattgtcatttggggattattaccatcatacagctcagtttatggcaatttctatacatgtgtttagtattaattgaaggaaactcataggaattagatgccagacatgaagactatatacatatcttcagagcgcttgtgtcctaaactgaaaagtgtgttttaagagtctgggatatgaaaccaccttttctctattcttgtcaaatccatgtcattctagctactgacataatttatgcaatataaatacaaataataataagcaaagttatatgaaaatatgtttccagtatataggtagttttaaccattctttttagaagaaatgtgtgtgtgtgtaaatgtcttaattgttaaaatgattaagtcattcacaggtttgttaatgtttttccatgtagctggagtgataataatttgtattacattttagagtggtttgatgcaaataaataagaaccaactcaaaatgttattgaggttaaactccaagaagacaaaaggaaaactaaaataacaaagtaaactataattaaaacatttcaactaagaaaaaagtaaaaagttaagctatctcagacaatgttcgagattgaagcttgttaattgcaatggaaaaactgctaattaccacaaatagtaatttagaggcataaatattacacaggtgtggctgcaggaagttgatattaatcaaacacatttggcattttcaatgttgcaaaaattacaattgtaaacaccttccatacaatcaaatgttatgtgaattttaaatgagtctcaataaattatactgcataaaaacaggatttttactatggatcataattgttaatgtcttccgtactcaaggttgaaatataaatcaattcactctattatttggtttggaagtttaagaggacaattcacatttcctttgatacactctaccagtgtcactggactggtgatgtgacaagaaaggtcttctgtagaactgaattgcaataatatggagattataacaaaattatatatgtacctaagaatattgactttaaaagccttcttcagattgcaacattgatttccagatctgttgggaactagctgccttacttaatgtaacagtcttggcaatggaataatcatatatatcacccatggataattaatttttaatcattgaaattcactgaaatatgttgaacatgaaaattatacaaatataattttgtatgctgtttcagattctttggaattttattctaagcatcaatcaagatggtatagtacgagaaaggtagaacatgtaattataaattcaggattcaggaagtttatttttctcttctttttaattctctcaaaatgatcttgattcctgcaaagtgttagtgtatctggtaagtaagagtctatttcttttaaacttcatctgtattaaccagctttatatgaccaaaatgtcccccaaatttaaatctttgcacagtaaggccttatatgtacacctggcctcatttcaaaagactaaagcagttgttctcaaattcagctgcacattaatataaactggaaaactgtttaagctcctgatgacaaagccacatgtgagactaatttatgctgaatcactgggccaaggacccaggtatcagcattttttaaaactatagaggaataaccagggttgagaaccactgcacaaaatggtacatgcaacttttatttaagttattttttttaaataaataatggttgaatcgatattgatcttagtaccaagtcatggcaattttttcagacttagagaattcatcctggcattgagattattaaagaacctagaaatccaagtgtttttgtttatatttttcctgtaaatattagagtatgctagtgctcatccttatttgataattttggaaaatatattaaacatttgagattgaatatcaaaaatctctaaaagaattttagaaataccattcttctatgaaataagtaagctcaatcaagatacatattatagtgcccatttaagaaagtctaataataatgcttgcactgcttaaagattaggttgataaattaattattgttaatcctacttgcataatcaacggacacctagcgatggagtcttaagtatagacacagaagttgaatacttttaagaacttttaaatttacatccgggttaagttttactttaaaattatgttgagtggttgtgattagtacatgtgtgattagaaccgtctttctcaggttattacatcatcatatagacacaggaaaaataatagaattaaaaataaagcaagaaaaataatgtaacactttattggcttcagataattattttgagattctaatcctaccaaaacattctgcttttcttaacttgatcctacttttgtttgtttgttttaataaaggatgaaccaatatcctgagaaattttcaaatagggctggttataacactaagaacctagatctcactatgttttagaaaaattgtaaagtatttcaaataatcagtaaagtttcagctctgcaccattgtgtctttgcaatatggggaaagtcacttcacttctctccctctctcgtttttggcacatgtaaggcagagaaaataatatctactccagctatcccacatgttattataaaatataataagagatagaaaatcactttataatgttcaaagtattataaaagtaagccatgattatatgtgggattaacagcagtttgttatttaccatttaatgtattcctaatgtacatttttgccatatttaaaaatgtttacatttcgatttttaagtgaaagagtaacggtatgacattatgccatgttatatctgatgccattatgtcaaacaaacaaacaaaagcattttaaactatttggaatcttaccaaaataaatcttataactatgataatacaggtttttgaggatttagtttgtacgcaaaaacagaggcaataaaggcaaaaatagataaacaggattacttagaattataaaccttgtgcagagcaaaggaaacaggagggtggagggtggagaggcaacctacaaactgggagaaaatatttgcaaaccttatatctcaatgtactagtgactatcaccctaataactagtcatgggagcactgtcatgcatttggtatgttttagttttcgggatgctgccacttaccacggcgggagcctgatccctgcggaatcgactgtagctggacttatcttgaatattctgagccaacataccaaaccataaggtgctaattcattcatgcttgaaggccataataatcaatacacattcacgcacacatgtacgttcacgcacacgtacgttctcacacacccgtacgttcacacacacacgtacgttcacgcagtatttaaaggagtgcttccgattaaatccgcagatctgccctccccccatctctgagtttattgttaaattaggtaagccagcccccaaaaacaagatacttaaattgaacctagtcagagccctaaaaatcataatttaaccatgaacactccaaccctagcccctcgattaacgtaattttctaaaaaatcctaacattctccaaccaaataaaatctcctatttcgatgctaactaaatctctgtcctaatacttatataatacttcaggtatcccgctctgaaaagcttgtatcccagatattatagtcctaaatcaaatataacttcaactacaaatggcccctcagcgaaaacctctgctagttcaacttttttaaaggccctaaacttccaggactgtaaaggaccactttagatttatacctaacaagatcctaccctgacatccccctagtatttcaaaataccactcaaatgtttttcacccagttaatgtagcttaattatttaaagcaaggcactgaaaatgcctagatgggtccgcacaacccggtaaacatagaagtttggtcctggcctgttttttgaattcttagtaaaaaattacacatgcaagcatccccgccccagtgagaatgccctccagatcacctggatcaaagggagcaggtatcaagcacgcataaacgcagctcaaaacactttgctcaaccacacccccatgggaaaaagcagtgataaattttaagtaataagtgaaagtatgactaaactatactaatatttatggttggtaaattttgtgccagccacagcggccatacgataaacccaagctaataaaactcggcataaagagtgtttaaggtctacattcagtaaagctaagctccatctaagtggtaaaaaactccagctgaaataaaacgattacgctccttgaggataagatgcatattgtaacaattttctatatcctccacaatgttttgcagattcaataactatttaatgaattgagttaaatttgcctatactcttacgctcataaataaccttctaattctcaattcctctaaaacatagaaaaaattgccaatataaaaaagcaagaaagaagatattaaccattttgtcattcaaaatatgactcattcttatacaactacctttgtcagcattcttgccattggactatctagactttgacgctggtatatcatggcttgttgttagagaaggtaaagtttggaaaacagaagcagttatgtaaagcaatcttagaaaatccttgagtttcccttagaattttgtgtcttctacatgttttctgtttcacatagattaagtttgcagagttatgtcataatttcatgagcgtatctgtcagagagccctttgaaggcctatttaatccaactaagaccattttttattgttttaataccattgaacttgttctgataattgaggaaaaagagaaagacattccatataatacaccagatgcctaagtgctttggatagtcataagccttttctcctatagcttcctatttagaaatgcctgctcttcagagttttcttaagctttccaacttgctccttccattttataagaataatagtctatttaggaagactattatcaaataaaaatcagaatgatcagtggacacctattttagccttgggatttatatcacaattccctaagactttatatttccagaaaagaaattcaaactaaaggtcacaattactattattatagtaatactgataagatgtgcattttaactaaaagaagttcccactatttttttttctttctacttttcaataatccttgggaccttagtaggagtgtgcagtagtcttgtggtgtatttttagtttaaaagtctgagcatacctaattaccacttggtagatattgttcaaactcacttttgaatccaagtgtttttaccctcatagaattttttttaaaacgagtatttgcttgtttctattatactgtaactattggagctactaggaggccttttaaatttcaccaacaagtaggcagaatggagactaactgaagggttgatgggcttaaagaaaataaataacctaacaaaaccaccaggctaatggcaaaaccaacattaggaaccaagtcactttacttgggattagtggataccaaaatgtgctttctcggaagcagcactttacaaggaaatatggaaatccacctttgttgtccttcagctaaagggaataaaatcatgtactttctataattttaaccctgttataacagatgctacatgaactcaagtggaactctgactgccttgagagctgaataaaatgcatcccaccatccgttgcagccgcatcaaggtattaaaaagagagacagaaggaagaggtgagagaggcacaagttcaacagtgtgaggcagtcagacacaatgggagggagaaagaaataaatgtctgaatgtcattgaaagaagagacaatgaaggcatatgtaagagtcctgctaaagctatggaacctcaggagcctatttgtaagaactacaatttagaatagggaacttgcaatacaatgcctgacctttatttcctttcctgcctcgaacttgtgaaaacctttgattgacttttctatgaacatgaattactgttacaatatttagttgaacaatatgaatttctcaaagcagtaatacagcgctacagcatagcttaacattgtttaagtaatatggtttgcttatatttaagtcatttctaagggacccatgcaaacacagtcaggagatctatttctgatgtatttccaaggctagaaacaaaaaaatgctgttaatgcataaacagtcaaaaaaccatgcactgtggttttacagggacctctatttctaaagatgattgttgcatgagggtctctgcctttatgaagggaaatgtgtagattttaactagctctgtttgtgttttgaaaaagaaaatcatgtttctgcactaaaaaataaattcctaatcaaacctttaaagttaacatttagaacagggacagaaacttctgttgtttcctaagtgttttgctgttgttcctgtttagttttaaatcattttttagaagttttattgaggtataaaaaaattgtacacctttcatatattcacctggatgaatttggacatgtgtgcatacaccaatatcatcatcacaaccaaggtactgaacatacttattcacctccaaaaattttcttgtgttcttttttaatggtggtagtatatttttaagaattcagcctttgagcagggtacgaaggaccttcaacaacaaatgcaaaagtaaatgagctaagttcatataaagggttagctctcagtgagttattcaagttatgatcatatcctcaagaggcttgtaaactgactgtgggtttccagtttggttattcacagataggccttcatttgctcattcacctattcattcatatagccactcattcattctcaagaagaggtatttgtccatatctcaccatgtggatgagcagatggtcagttctcacttcttttgccattaagtgtgctcaccgttgagctccaggatggtattttctctcactttgcgtcattaccaaagtggctatcaagattccctcccctaccttctttttcttttttcaatgtttaagagctggagttaatttcttgactcctttggtaacacatgccgatatataccactcaaggcctgttggattaaactgttaaatttgtcatctagctaatgttttctcagaaccagacaaattaaacagagtcaattgttgaaattatttcaaaagataaacaatcatagaatggaaataaactacagaaagtagggaacaggagtaactaagtctcctagaaaacatttgcagcagatgttaagtatccagtctcgttgttataaatgaatttcaaagaatctcatgaggagcagctttacaaaattttactgcactaacaaatggcagccaacctctgtagtaaacacaaaatactgtaccatcctttgtatctccttaaattaagccaatttctgcttacacagaaaatctgtctgtggaaaacactgcttagaatttgaaagcacattaatctggaagccacaacagaagtgtgcttcagaaaacttcttaatatttttcttgtgagttattctctttacgcttttcacattacaatattaccaagttatcataatgtattttctgcactcccagagcaagataagactctagtagttgctgggaactatgcattgtctaaatatgggttcacattctctcacagtgattctggaatcatacacacaaatgagatcactgctgtcagatcactgggattaagactcaacctctctactcactggccatgtaaatatagatacagtactcagatcctctgaggcttagctaattatcagttgatttggtctacacttaccacattaattatttgaaaggattcgttgatataacatgtgctgacaaccataatcattattaaggcaatgtttaccaatatgtgactttaaaacagatactactattagataacaattcatactatacattcaatatttaaacaacagaattataattttgtgaagcaaattttgtactcaaacagaaaatccaattctataattattttctgcaatattgggtcatagaaccaacaaagaatatatgactggcttagacgtatgtaattacttatgcaattagtaataaaattcttcactcattcctagatttgaatccctgatgctctgcgtagcagctgtatagtcttggacaagttgcttaatctgtctgtacctcgatttcctcatttgtacttcaattttcttatgtggtaaatataaaattacttaactcagagctatgaggtcagttttatttgagagaatccagaataaaatacttagcacacatttcctaccattcagcatgcataatacgtactcaaggaaattttagatctctgtacatgattaatatattaaatcctcaaaccgactataatgtctgaaaatgcatgtctttatgtcactgtacctctcactgcacttggcacagtgttgtgaatatatttgtcatttgtatgttctttctaccatacaattctgccactccaattagcatattgtgttggaaaacaattgggtgcttgccttatgttttactaaatttatacggaactacgttgacacttccttgcccttcagatgctggcactcactggttgctttctagttctcaggagtctctgtgtgactctgtcctttacacttgccctgcaacatcaccctcagccctagacaaagccaacatcatttttaaaaacctgcaaatatgtctgcaattcactgtatgaatattctcattctatcaaaaccctgacctcactaactcaatggagcaatacaggatgagaaagtagtttatatgaaagtcatagaaagcttgctttgtttattcatccaaacgtatgtttttaaaggacgaggcttttatctgaaacaaataaaattataatttgaaatttcaaataatgtgactaatagattatgaattcatttccaaatatagaaataattaaaacacttggggtatagaaaaagtgagtgctgtatctattcttttcttatattaattttaccccagctgccagaatttagttttttgtttttgttttttttctttttctttttttgagaccgagtctcgctctgtcgcccaggctggagtgcagtggcgctatctctccgctcactgcaagctccgcctcccgggttcacaccattctcctgcctcagcctcccgagcagctgggaccacaggcgcctgctaccacgcccggctaattattattattattatttttttttttttttgagacggagtctagctctttcgcccaggccggagtgcagtggcgccatctccgctcactgcaagcttcgcctcccgggttcacgccattctcctgcctcggcctccctagtagctgggactataggcgcccgccaccgcgcccggctacttttttgtgtgtgtttttagtagagacggggtttcaccgtgttcgccaggatggtctcgatctcctgacctcgtgatccgcccgcctcggcctcccaaagtgctgggattacaggcatgagccaccgcgcctagcgcaaagatgtattttactaataccacagaggtataatctgctgctacttcttgatcaggagtaaacaagtttacttcacagcagttgatctaattttcttccccattcattcaatggtattttttttattgttatagaacatactgaattggataataagtccttttctttttcttttttcagaaatggtttctactctgttgctgaggctggagtgcagtggcattatctcgactcactgcagcctctgcctcctgggctcaagaaatccttcgacctcagcctcccgagtagctgggactacaggtgagcaccaccatgtccacctatataatttttgtatttttttttttttttgtagagacagggtttcactgtgttgcctaggttggtctcaatctcctgggttcacaccatcctcctccctcatcatcccaaaattctgggattacaggtgtaagccactgcacccagctgagaaggctttttattataggttgttcttattgttttatttatttggtttacttgttggttttcaaggtaagtttgacatataaggtggtataatgtttaaaggtcaagttatagagatagctagattgaagttcaaatccagagccaagttacttagactctctaaggacttgttttttcccttataaaattaaaataaagtggatagccacttcataggtttgtaataagaattaatatgatcatgatgtcacagagttgcaaagagatactgaaacttggctctgccaaaaaatattagctattgccattatgattgttctccttaatacctaaggcatttgctgacagtcaggttactcatcatgtccttccaggaaaaaaactttaagaatgttgaaaacttaggaactacttttaaaatttaattttcagacctgacataacacagctgaggaagagaggtggtagctgattggggatagatgtagagatcattaatggtataagagtgtgagaatgtgaagcaggataggatatgatattactcatacagatcacaaatacatgtcaaaattatatttatcattcatttaagtaaaattcaacattgttttcttcaaagaagaaattgcgcatttcactctacctatttaactctggaaaattttacaaattgagcatgccattttttagtatgaattcctttatttcagctgccctgctaactttggcatgatgagcagaaaaaaaataaacagaatgattagttctgaaatatgaaaaagtgtccaagaaaaggagtagtcttgagaagtagggaacaggatgaagtcactaggggacagaagggtaggagggagtgggaccagacaaacactgagctctgcatgcacacgtaacagtctaaaatagtcatccagcacgcagactctaagtcaagataaccaagatgaattgccaacttctccacaagcaatatgactttgggtaaggtatttgagttttctgtgtcttagtttcttcaactgataaataaaaatgatggtcatatctacttcataaaattgtgataattgattaatacatgtaatgaataacgtttggcatttagcttaataataagacttttcattaaaatattagctacttttgttagctagcaactctcagttttgcctaaagctgaccccatatctagggtgaggttttgaaagaaattcaacaccatcagaagtaggtctggaagttataaaggaaagcttaaagaaacagaaatatgtgcaacacctatttacaaagaatccattgggaaaaccccattgagcccagggagatggcacatgtcccctttggttatggaattcagttccctgacggtcagtatactgtctttgttcccaaggcaaactttttaataattgtgatcccactcaatagtcatgttcacttactttatgggtacatttgtggcatattttaaaatgtgaagttgagtgcatttcacctgaaaaccaaaggcatgtaatgacaacatgctatagaggaaaaattattgatttgtgtaaataggcagatcttgtttgtattctagctccatcacttactaattttgtgatatgggcaatttatatcctatctgagcctgtgtttcctctacaatatgaggtaatttctactttgaagtattgttatgagggttaaatataaattactttctggtttatgatgttggtatatactacttctatgcacaaccgttatttttatgaataagattttaacagtaagccacagaaaatataatgtaagactgattcttagaatctatcaaaacaggttgtaaaaatgacttaaacatctagcatggcagtgactaacattttgaaaagcttaatttttccattaagaactatagcccaacacagtgtctgtgcttcagtgttcctcttatcaggaaggataatatgtgtgatgcatggactaactctaatgaaaatttttattcttaagacacaaaatatttcccagcacagtacataaggtctttgtgcttatgtcagcattggagataaatttctgggaaagaagtagagaaactgctcatttctatagacatcaaaacaccaaagtagccgggcgcggtcactcatgcctgtaatcccagcactttgggaggccgaggcgggcagatcacctgaggtcaggagttcaagaccagcctcaacatggagaaaccccgtctctactaaaagcacaaaaaattagccgggcatggtggtgcatgcctgtaatcccagctactcgggaggctgaggcagaagaattgcttgaacctgggaggtggaggttgcagtgagccgagatcgtgccattgcactccagcctgggcaacaagagcaaaactctgtctcaaaaaacaaaacaaaaaaaacaaccaaagtaaaagtgaaaataaaggtacacagcagactttttctttttaaatacctaaactgaaaagtatacctgtcaagaaacatccaactcatgaattactttaaatatgtttttaaaacagcgtgcttgttttataacaatagattcatgctagttatctgatattccccagtggttgctttgtggagctcagtgtcatccttggagaacatgggcaataaaaagcatttcttctgcaccagtaagacaaaaacaaactgactacttctcacataaaccttggagggcttccctcagtggggttagtgatcagcaaatcatgtcaaataaccccttttgttatttttgacataatagtgttcctagcagacagtactcaagaattcccagattcttagctgtaacataaatttaatatactctcttttattaaaagtcaagctgtttattcacagtagctcttaggtctacgtttcattttacacatatatgtggatgtaatagctttttccttagaacttttaaaaaatagaattcagtaaaagtcctatatttgtattttctatgtgtcaagaacagataagcatcattaatgtgaaccaaatttcaattgaggagctgaaattaggaagaattgaaaaacacctgaaataaatcttcaagtaataaaggggaaagtttactttagaattagtgtatcaaaaatgagaaaattggctgggcgcagtggctcacgcctgtaatcccagcactttgggaggctgaggcatgcagatcacctgaggtcaggagttcaagacctgcctggccaacatggtgaaaccctgtctccactaaaaatacaaaaattagccgggcatggttgtacatgcctgtggtcccagctactcgggaggctgaggcaggagaaccgcttgaaccccggaggcagaggttgcagtgagccgagatcacaccactgcactcgaaactcggtgacagagcgagactccataaaaatcaatcaataaatcaatcaatcaatcaataaaactttttaaaaagtcattgcattatttttaaaaaattaatagtttcaaaatgtatacatgtaaaatctaactgggaatactttgtatctacttgtagcacaagattaaatttattttcaattactaggagatttgcacaatagagtatatatttactttaatctgtatgactaaaagcctcattgtcaatgtgactatgtcatcattatcacattcatgaatctcctgattataacctgcacagatggtctacctacagggctctgggataagaaacttgctgtctgtctacagaggaagccgttttcacttccagatagttctgaatatttgcaagtacttgctgatttagagtcaaattatgtcttgctgtaacatccatgttactgaacttacatttgagataaaccaagattagactaaaccatgccttcaaatgacactctcaaaaatgtgatgcaatttatgtgccaaaactatcctatcttgccattttcctccattttttaggaaaagcatggtcctagttttgttagccacagttgacactactattttaaatcactatgtcatttgtatatcctacatttgaacactctttagtgtcttcaagttaaaatatgcataaaaactgcacgtccaggatactctacctggagaaaaacatagctctcattaaccttgtccagacattaaacttataagagaaaaatcattattttcctgtaaccaaattactctgctaaattgtttttaggcaggattaataaatctttactgtaaagggaaagaggctaagattttaggttttgtgggccatataatctctatacaactgttcaactctgctgttgcagtgagaaagcatttatagacaatatgcaaatgaatgagtgtgtccatgctgcaataaaatttaatttattgcagtctattggctggatatggcctgcaggccataatttgccaacccttggttgacagtatagctagctaaacactgcttgttgtagtaaaatcttgctttttaaaacatatgtctctcatcctagtattgtcattacgtgtgtgtggtttattgttaaatatgtaatatttaagggtctttcctatttagttttattaactaaaagctgtttcataattgtaatgcacagacatctatataggtttttattttatcattcaacctattagctaatccttagagttgtttcatttttcatgtgtttgacagatgaacatgtctaaaacactgatgataatgttaccagaatataaacaaaaatgaaattttcaggttaaaaccattttgttagtaatatgtaagtatatcaattaaccattaaataatttaccaaattattccattacctaatccatattgctccttcttgtccacaagaatatagtaaggtacattgtcaaatacatacctctgactttagtgggcatttaatgtattattagaggatcctgatatctgtctttcttaaagaaattaaactcatccctagtgattatactttcttcatctaacactataatattaataacatttgaaaaaataatgtctaataattaacactagatttacagagtatttttagacaattttctaaaattatctgaaaaatttgaccagaatcattgtaaaattcacatctgagcttatgaaagcccactttattccactctaaaagaacaaaattttgtacttttaattttatcttttaaaatgttttaacataaaggtagtgggagacgttactaaaggaagcttagatagtaacgtatttgttgtctcagttaacacaaagaccatagatggggcagatctgcaggatgcaaaaactttcctttttctcacctcatagtagtcatatggctactgcaattctctggtttcatgtgcttacaaaatgtcctttagttaaaaataaaaagaaagagaaagagaaagagaaagaaagaaaaagaaagagaaagaagaagaaaagagaaaaaataatttcttcatgtgtctatttaaattaacaaagacgtgaattgtcccagacctccctgtgatgagtaacttcatgtgtcagttttactgggctaagggttacccacatggctgataaaacattatttctgagtatgtctgtgtttccagagaaattagcatttgaataggtaggctgagtgaagaggatcatcctcaccaatatctatgggcatccttcaatctcttcagagcccaaataaaacaaaaaggcagaggaagggtgaatttaatctgtcttcttgagctgggacatccatcttctcttatcctctgatattggaacacctggttctcagacttttgggcttaggttgaactatatcactaactttcctgggcctccatcatgcaggcaggagattgtggaatttctcagtctcgacatccttgtgagccaattcctcccaagaattatcttcttctagctatctctgtctctttctctatctatttcatctgtatcagtatctgtatctctgtgtcgtctatatctgtatcatctgtatctttatctcatctgtctctatctctatctctacctctatgtctacatctgtcttagttatctatctcatttatggttctgtttctctggagaaccttaactaatatagtccttatcttacaactcacttgccagcttaccatgattataaccaagttgatcacttcaaaagaatactaaataatatatattgtttacactaagagatagctagctactctcctcaagctgaatctggcccccacctcacttagtagagcaagcaaactaaatgtagattatacattttttactcattgaaaaaacccaaataataacttatgacatgctaaaatttaaattttgatatacaaataaaattttattagaacacaattatatttattcatttacatttacattatttgtctatggctacttttacactaatgcagcagagtttgttagttgagacagaaacaggccaataaagaccaacatttttacaatataaccctttaaaaaaaaaatggacccttggtttagactgatcaataatcctatgggaggattttaatgattttcatctgtagccaaccaagcacattttttttcttggctaggataaatttagaacatctatgtccttccttaaaatagccccacatacttgaaagtctgattctctcataactatatttttttctctgctgttaaaatttgaactcattctcttcagaaataaagaaagtaacaaaatagaaactaagcagtcccatttttattttgccatttatgagggcctatgccatctagcggtgatttagtatgtatttaacaaccagttcactgagaaaaactgctgtatttttagtttgcttaatttagtggtgttgaatatttcctctatgaccaattttggcttacgaatatgatttctttgaatgcaaagttgggaggagatgagcactgtgtgctcctatgaggagttccatctggctcaaacataaacactattaacatcactttgctcaagacatgtgattctctttcataatgcttcttgcattaactgcaatataaaagttacaatccttattatttttgaaaaactcaatttgtataggactcttgataatattttaatatgtatacattttataattttattgatattttttcttcttttatacttttttttgtttatttatatagtttgttttcacattaaatgggagaaatactgacattgttcaattcacacccagggaaattctgtgtgaatgatatcatattatatttcttttaatgctctaaacaatgttgtgaggtaagtgttatctctgatttgcatatgaagaaacatattccgagattaaaaaattgcccagtttcacacaaggaataaattggagcacaggagttctatatagatagacctgtatgacttcacagagtgaaatggacagataaacaattcactttccaggagaaatcacaggacaatggatatcagaagaaatgatgggaccagggtaatattggatgttttgtatataaaaaactaatgtgggcaacaaaaaagcatataaagtcactgaagcaaaatatatattgtgaaatctaaaagaaaatatgctattggtaggccatggctacattataaaaaacatttcatttcacataaagtatgaatactacactatgactatgagttaatattaaaaaattgaccacataggaaataggagaaaaaagtaacaacactgtggaaagcaaagaaaatgactgcaagatgaagctatcaccaccatctcgtggccacatacggacctcctcagaagcttagatgaataaagggaagagactggagttattaaaatttgtaaactcagagtaaaagccttcctgagctgaggctagacctctgagggagagaaatgttccaactgctgctgttacctctgaagaggcactttctggggctctgaaaaaattggtaaactgaaacaattactgctcctagggcaaggggatgttcttgggagaatatcagcaaggacagcaaacaaacaggaaaaggagatctattcttccattctcttgcctatgtttctctagtacctcccaatagcagtacgtagcaggatcccacttgaaggaacttggaaaacgtagcttgctgatccccatcacggcatcatagcaaatttatttcagagaaatgtggctaaagatcaagattattagtaaatcaatttttttacctaatttttaatctgtattgatttcttataacataaatatctgtggttacagagacctcagtattttctttttcttctgtagcagcatttcaatcttttttgaagttctacctctctttcactgctagttcacaccatgtgagagcaatggacctaatcatcatgggcagtggtcataatatgtctcaacctgcccaaaataaagatgctaccccattaaccatatgttttattttgtaatacgatcatgatccaacctagtctaatgagaaacttaactagaaattttgttggaattattgaggaaaacagtgttcattttctgaaaaagtagcttagctagtaagatataagctcagtgctactagtggccatcttgatgtggaacaatactgagaatatttcttcaggtaatcctacaagaaatgtgtgcaaaacagaaaagaggaagttacaatgagaaatttcttacgtactatattcagtagagcctcagggtagctctaaatctagatacttaataagaatactactgataataaataatactcatatagcaaatactatgtgctaagcattctttcatgtactttataagattaatatatctaatacaaggactgtatgagatagatattattgtccagttttattatgtcctgcaaataaaatgccctgacaaattatattctctcaatcatctttcctttgtttgcaatcaacattttatatgtattcacttattatgtatcactcctttgattcctcaaaatttatttagggctatataaatattttgctactactggaattagcaaaactttaaggttaaattttcaaacatgttattgccctcatcatactgtagcaagaattagtaatcaatgatacataaaccctatttatttatccaaattattccatttcacatcctcacaaaggacactattctgtcaccatttaaccctgttccccaaaatctcctcataaatgcagtttcaaaaacagcaaatagataaattggactttattaaaattaaatttttttttttggtgaaatggagtcttgctctgttgcccaggctggagtcagtggtgccatcttggttcactgcaacctctgcctcctgggttcaagcaattctcctgtctcagtctcccaagtagctgggactacaggcacgcaccaccacgcccggctaatttttgtattattagaagagatggggtttcaccatattggccaggctggtctcgaactcctgaccttgtgatctgcccaccgtggcctcccaacgtgctgggattacaggcatcagccactgcgcctggcccttaaaattaaaaaattttttttaaagtttttatttttttgagacagggtctcatcatgttgcccaggctggagtacagtggcgccatcatggctcactgcagtttcaacctctctagactcaagcggtcctcccacctcagccttctgagtagctgggactgtaggcatgtgccaccacatcccagtaagttttgtattttttgtattatagaaatgggggccaggcacagtgctcactcctgtaataccaacactttgggaggccaaagtagatggatcacttgaggtcaggagttcgagaccagtctggccaacatggtgaaatcccctctctactacaaatacaaaaattagctgggcatggtggcacgcgcctgtaatcccaactacttgagaggctgaggcacgagaatctcttgagtctgggaggtggaggttgtagtgagctgagaccatgccactgcaccccagcctggttgacagggcaagtctgtctcaaaaaaaaaaaaaagaaagaagtggggtttcaccatgttgcctagactggtcttgaattcctgggctcaagcaacctgcctgccttggcctcccaaagtgctgggattacaggtgtgagccactgcacctggccaaaattaaaaacttctatgtttcaaaggacatcattaagaaagtgaaaagacaacctacagaatgggattaaatatttgcaaattgtgtatctgttaagggtctagtatttagaatatgtgaagaactatcacagctccataagaaaaaaacaaataatccaattgaaacaatgggcaggccaggtgtggtggctcacgcctgtaatcccagcactttgggaggccaaggtgggcggatcacgaggtcaggagatcgagaccatcctggctaacatggtgaaaccccgtctctactaaaaatagaaaaaaattagctgggtgtagtggcgggtgcctgtagtcccagctactcgggaggctgaggcaggagaatggtttaaacccaggaggctgcagttgcagtgagtggagatcgcaccactgcactccagcctgggcgacagagcgagactccgtctcaaaaaaaaaaaaaagggcaaagaatttgaagagatatttctccaaagaaaatgtgcaaatggccaaataaacacatgaaatacacacatgaaaaggtgttgaaatcattattcattagggaaatgcaaataaaaatcacagtgaggccaggtgtggtggctcattgcctataatcccagcactttgagagactgagtcaggaagatcacttgagcccagaagttagagaccagcctgggcaacatagggagataggcgtggtttgagcctgtagttccagctagtcgagaagctgaggtgggaggatctgcttgagcctgtgccgtcgaggctgcagtgagcagtgatggcgccactgcactccagcctgggcggcagagcaagaccctgtctctaaaataataatgataataataataataatagagataccaattcacacccactagaatgactataataacttaaaaaaaatctcaaaaaaaaaaaacccaaaaaacaaaaccccaacaactgttggtgaggatgtggagaaatgggaacccttatagggttccttacttatagggatgtaaaatgatacagatgctatgggaaacagtctggcagttcctcaaaaagttaaacatacagttgccatatgacacagcagttccattcctaggtcatcccaagagaaatgacaacatatgtccatacaaatacttgtacatgagtgttaatagcaacaatattcataattgtaaaagagtgggaacaacctaaatgtagatcagctgatgaatggataaacaatacgtggtccagctgggtgtggtggcacacacctgaaatcccagcgctttggaaggccgaggcaggtggatcacctgaggttggaagtttaagaccagcctgaccaacatggagaaaccccatctctactaaaaatacaaaattagccgaacatggtggctcatgcctgtaattccagctacttgggaggctgaggcaagagaatcgcttgaacctgggaggtagaggttgcagtgagccgagatcatgccattgcactccagcctggtcaataagagcgaaactttgtctcaaaaaacaaaacaaaacaaaaacaaaaaccagtatgtggtccatccatacaatggagtattattcagccacaagaaggagtgaagtacagattcatgctgcaacatggataaaccttaaaaacattatgctgagtgaaagaagccacgaaagatcacatatggtatgatcccacttatatgaaatgtttagaacaggaaatccatagagatagaaaagagatcaatggtttctaggagatggggagggaggcaattgggaatgactgttaataggtatgggattctttttaggtgatagaaatgttctggaattagtgtagatggttgcaaaatgtgaatacgctaaaactactgaattgtatactttgaaatggtaaattgtatgctatgtgaattttatctcaattaaaaaaaagtataggccgagtgcagtggctgaagcctgtaatcccaggctttgggaggccgaggcgagtggatcacttgaggccaggagttcgtgaacagcctggccaacatggtgaaaacccatctctattaaaaaaacaaaaattggctgggcgtgttggtacatgcctgtcatcccagctactggggaggctgaggcacgagaattatttgaatccaggaggtagaggttgcagtgagccaagatcacaccactgccctctagcctggtcaacagaacgagactgtcttgaaaaaaaaaagataaattatggtatttgctttggaattaaataattagtaacctttagtaaggtttggtaaaggtttagtaacctttagttaacccagttaacttctgtgtcttatgtttgtctttgtactgaagtagttgaatgccactgacccacagaatgagttgccagagaattggagcaacattctgttgtgggaaagagaatactctgttctaccttaaaattagattcccagcatatcaattgaagggttttaaatagtgagtgatgtgtttcaatttatatttatattatatttacacttgatcttagccaaaagtctgagaagtgattttatattatatttataaagatcactttagctttctcctggagactggattggtagggacaaggtgacattggtgaacttggttagaaagtcagtcaagcccatgtgcagtggctcacgcctataatcccagcactttgggaggccaaggcaggtagatcatctgaggttaggagttcgagaccagcctggccgacatggtgaaaccccttatctactaaaaatacaaagattaggcaggcatggtggtgggtgcctgtaatcccagctactcaggagattgaggcaggagaatcacttgaactcgggaggtagaggttgcagtgagccgagattgcgccactgcactccagcctgggcgacagagcaagactcagtctcaaaaaaacaaaaacaaacaaacaaaaaaccagtcagtactctagggaagaaataacaatagctatattatgacatagtagtgagttgaagataactgaatagccaaaatatattttggagatagtttgatgtgagaggcgaggaaaagtaagtagtcatgtgtggctctttgtttctggctttaataactccagtagttctggaagagacttagtgggaaaattaaggacattttggataaattgagtttgtccaaatggggttgccaagtggagagttgagtaaatgaagctagagctcaggaaagatgtggaccagagttataagtcatatttatttatttatttattttgagacagagtctcgctctgtcgcccaggctggagtgcagtggtgcgatcttggctcactgcaacctccgcctccggggtcaagtgattctcctacctcagcctccagagtagctggtattacaggcgtgggccaccatgcccagctaatttttgtatttttagtagagacgggggtttcaccatgctggccaggctggtctcgaactcccgactttaggtgatcctcctgcctcggcctcccaaagtgtttggattacaggtgtgagctactgcgcccagcataagtcatatttaaaacaatgggaatgggtaggaacacctagggatagagtgtgggaaatagagtagggtccagtatacagctgtgccaaatttcacatgtacaggttagatagtggagtgggtcagttctattgagaatgccctgaaagtttgaataatgataagcacgtccattttaacatcatgaggtagtggtgacgttgtaagaggagtttcagtgtagtgggttgtcatgggttaaaacgttcagattgtcatgggttaaaacgtgaattggatatgaggaagtggagtgtgcaaagatagttttctgaaagttttacttggaagaggacaaaaaattgagactagacagtttgaggaggatgaaaggtcaagaattctaagctagtgataaaaatttcgtcaacatcaatgaataggtaatgtaaacacattaatcctgggatggatgtgagaagagcaaagaaaggagtcatgggggaatatcagctctaaaggttgagtagagaaggaaggagtgatctgagaggtggaaggaggagtaggaattatcatagaaactttaagcttcttgagggcttgtgactgtgtcatgttcatcattttatctgaagttcttatcaacaaagtagctttcagtaaatatttattaaatgaagacaaaaattttaagagccatctgcaatgtcaaatgtagcccacagttgaatgaatatgaggaccgggaagtgtcccttgattttggagttaagcagctgattgccaccttctgtagaacagcttcagtggagtctccatgatagaaataaatgccaggttgctgaggactaagcgtggatatttgttgagagtggagacagtaagtgcaaacattcttttcagaaagctttgctctttttgaagctttgctcatagggagatacaagatagtaggtagaggggcaggctgtgtttagatgagagagacttcagcatgtttatatgctaaatggaaaaaggaaaaaggaagggagaagttgaagatgtagaataaaggaggtgtgtgtgaatgattgtacattgtctttgaggttagtgggaatggagtgaagatactgggttgcagtacagatgagaatacagtttccactgaagtaggaataaaggaacaatagatggtgcagatggggaagtgtttgggtggcaagtgagaattctggatatcaacactttatttttttcagtgaaggggggataaggtcatccactgagattatagtggggatgaaatgatgattgtaggggactgaggagaaaaggagaatttcaagaaagcctctgagggaagtgagagggcaagctgagtgggaatacttagaaaaaatggaatcatggatttttcacggctgtggtatatatatttgtatgaatgatttcctccttctctcagggctcagcagcctgggtgagcacacaattgaacagttggattggtcttggcctgggttttatgcgtcagtgtgacagagagggtaaggaggcaagatatttcagtagcgagagtgtttgaagtggtgggccattgagtctaggctgaatagggaacaaatgacaccagaaggtggctgctgggacatgaagtggttggtgttcaagactggatagtggaattgaagattgaatgggaggagcagttgctgggtatgacagaatacaggatccagctatggagtgggtttatgaagtagagacaacgttcccaagtctttagtgaacatcagagagtgtcatctgttagaactttagctgtggccaggcaaggtggctcatgcctgtaatcccagcactttgggaggccaaggtgggcagatcacctgaggtcgggagtttgagaccagcttgaccaacattgagaaactccatccctattaaaaatacaaaattagctgggcatggtggtgcatgcctgtaatcccagctactcgggaggctgaggcaggataatcgcttgaacctgggaggtggaagtttcggtgagccgagattgcaccattgcactccagcctgggcaacaagagtgaaactcagtctcaaacaaaaaagaacttttgctcaaaggcaggtggtagcagataagaggtaaggaaaatttagtgaagaaaaattcagtttttaaaaacgttttaggctgggtgtggtggctcacgcctataatcccagcactttgggaggccgaggtgggcagctggcttgagcccaggagtttgaaaccagcctgggcaacatggcaaaacctcgtttctacaaaaaatacaaaaaattagtcaggtatggtggcatgcacctgtagtcccagctacttgagaagctgaggtgggaggatctcttgagcccaggaagttgaggctgcagtgagctgtgattgtgccactgcgctccaacctgggcaacagagggaaaccctgtctcaaaaaacccaaaaaaacaaaaaacaacattttattttggtgatggaattctctattgtttcgaagagttttgtttgttttaaagacattaaccagttttctcgagggatattctatgaaaaagtgggttccatcatccaataagtttgagaaactgcaaactctatcccgttggtaattcacaatgaacctcaacttagattaataaaggctctgggaaatgatgttactattaatgatttaacatttattgagcactgtctaaggctctgttctaaggctcccacatgcattattgtttccagtctttacagcaactatctcaatttaagtcacacggctaagctggaatggaagagctgggattcaaatccagaaagacttgctccataggattctcaagcctataaccagtatggaaacaggcttgacattaaatccagcatttccccatcttgtttggttatggaaccttattatcttttagtatttatagagagattagtcagttgtccacggcatggaccctgggaagtgtcgcctgagtcagtttacactggtgactacagtcttttaaacagcattgtttcagactataactagttttttctaacttggttctctgttgataatacttaaatgttatatttatttttctatttgagagccttatattttgacttcaaggcattttctattccctttcacaatgaccttcccaggaatcaaagatattgtcaccaccacacattacatttgagttactaaaacagtttataatccaaatagctatttcactttcctttctctggtctaagattatcttattgtaatttgttttttaaatttagagacagggtcttgctatgttgtccaggccagtctcaaactcctgagtagctgaaaatataggcatgtgtcacctcaaccagtttattgtaaaattttaatgtttagagatcttggagatcatcttttatttttaacagtatttatttagttttgcaggtagagaaaatgacagctgtgtagtgctgtggaaattataataattcatatccaagcttgaatgtcagctctacctctttactatagctgtggccttacaaaacctacttcgtttcttgaaacttgtttcttcctctaaaaagatgaggataatatcttgcagggtggctatgaaaattaagacagttcacacagtatctggcacatggaaagttctcaatgttaattacccatttttttctgtttaaggaaatagtctcaatcctataccatgaatgaattatgaaaatagttggaaaggaaacaacagttttaaatgtaaactgtctcagtcttatgctgacatcagctacatttctggtaaagtgatggtgtcatgatacaggttatattaagagttaaaaccagtttccttctggctttccaactgacataataagcaaaacctgcctgggcaaacatagacctatttattggctcacttattattaatgttaaagtagctttggtgctgacttctcctgttcttgttttaaaatttcactgttgtcatttgaaatctgacagaccttcagaagcttcatagaatgcttaatggtttaaatcgtctctagaacatgtgaagtatcttttccaaagtggttttctccatctgtcagtatgttcaaaatcatgtgtatagggccgggcgccggtggctcacgcctgtaatcccagcactttggaggctgaggcgggtggatcacgagatcaagagatcaagagatcaagaccatcctggctaacatggagaaaccccgtctctactaaaaatataaaaatcagctagccatggtggcacgcacctgtagtcccaactactcgggtagtcccaactacttgggaggctgaggcaggagaatcacttgaaccagggagacggaggttgcagtgagccaagatcgcaccactgcactccagcctgggcaacagtgcaagactctgtctcaaaaaaaaaaaaaaaaaatcatgtatataggacagaattgcttatattttcacatttactactggatgcctgtttggttttcatagcaatcaacttttggagtttatgggcagtacttaacatatataacctaagtgtggataattatttaaaataaggctattggaagaaaaatctatagggatttctcagttttcacaacaactccctgagcaaagaaaaaataggttggtttgagttgtatgtgatgagatttctaatattctatttgaaatgccccctagtaagcactagtgataggtattaatgagctgaatttgatttccagttccaactctgtcccttgcaacttctgtaaccttgaaggtttctctacgtttcagtttcttcatatgtaaaagagattaccaatatttccctcccaaggctgctgtaacagtgaagtgttgaggtttttatttatttattatttatttatttatttatttatttatttatttatttttttgagacagagtcttgctctgtcgcccaggctggagtgcagtggcatgatctcggctcactgcaagctccgcctcccaggttcatgccattctcctgcctcagcctcccgagtagctgggaatacaggcgcccgccaccacgcccggctgattttttctatttttagtagagatggggtttcaccgtgtcagctaggatggtctcgatctcctgacctcgtgatctgcctgcctaggcctcccaaagtgctgggattacaggtgtgaaccactgcacccggctgtgttgaagtttttaatatagccagcacagcatgtggcacatagtaggcacacagccattgcatgtttcttccagacatctcactgcatttttcagtaatattcttttcaagtacgttcttctttctcattccttaacatttaaaagctatattcaagagagaatattaatgtttgccaagtaaactgaaaatatttcctttgcagcccacacttaagagtgttttaggccgggcgcggtggctcatgtctgtaatcccagcgctttgggaggccgaggtgggcggatcacctgaggtcaggagttcgagaccagcctcaatatggagaaaccctgtctctactaaaaatacaaaattagccgggtgtggtggtgcatacctgtaatcccagctacttgggaggctgaggcaggagaattgcttgaacccgggaggcagaggttgcagtgagctgagatcacgccattgcactccagcctgggcaacaagagcgaaactctgtctcaaaaaaaaaaaagagtgttttagcaaaaaatgattttatgtatgacataccttggtttaaatcctggctttttaattgtaatttttttattttttgagacagggtcttactctgtggccaaggctggggtgcagtgatgtgatctctgctcactgcaacctccgcctcccaggctcaggtgattctcccacctgagccacctgagtagctgggagtaaaggtgtgctccactatgcctagctaatttttctatttttagtagagacagagtttcaccatgttgcccaggctggtctcaaactcctgggcttaagctatccaccagcctcggcctcacagtgttgggattacagttgagagccaccaagcccggcctgaatcctggcttttgaatgtaatagtgttgtgaccttaggcaagctacttaacctatccctaaagtattatgaggctaaagtgagtaatagtatgtataaaacatctagttcattgtctggtttgtatattcccaaaataaatgttattattttaagtggaaactgttgtttaatttgataattcatataattcatggcttttgagagcctgctctactcaaagcccgttaagagcaggcaggaacattgtgaacgaatgttgggcatattattatgcaagtgactgaatttggccttgcctgtaatcaggttcagcaaaagtggtattttctttctttctttctttttttttttttttaaattgagacagtctcgtcctgatggccagactggagtgcagtggtgtgatcttggctcactgcatcctccgcctcctaggttcaagcgattcttccacctcagcctcccaaggagctgggatcacaggtatatgtcaccatgcctggctaatttttgtattttttgtagagatgggggttttgccatgttggccaggctggtcttgaactcctgacctccagtgatccacctgcctcggtctcccaaagttctgggattacaggcgtgagccactgaacctggccaaaagtggtattttctattgcatttgaggtaacagaaattgatgggcttgttattgcatttggcatggctttttttttttccatgttgtctttctccactgactgtcaaaaaaaaaaaaaaaaaaaaaggctacattcatgagtgccacaagagagatccatgattcccaagtgctacagcagaccaaggtatattttggtatctaaaatgtttttcatcttttgctgatcttgtttattagaaataaatatgttactctcctgtattaaaatttaacacaatattggcaagctaaatttaatcaaatattctgcccattttaaaattcacttcctagcctgtccatccttccttttattttgttgtttgattttgttttattgtatgcttttagcagcctgaagccatggtttttagtttctgtctgtagtgataagtggaaaggagggatgaggaaggggctttactggcccaaccagaaatagaaactaagaacccaggactgtattatctcccttggacacccaacactatataaaattgattcctgccctggcagactaagcattggaaagctggtgctaagagtgttatgagaattcctaacaaatagaaaagctcaaggattgacactatagtaaaagatttcattttgacatgtttataatttacttatcaagttaacaataaggtgtttttatttatttatttttgtttatttttattttatgttttgagacggagtctcgctctgttgcccaggctggagtgcagtggcttgatcttggctcactgcaagctctgcctcccgggttcacgccattctcctgcctcagcctcccgagtagctgggactacaggcacctgccaccacgcttggctaattttttgtatttttagtaaagacggggtttcaccatgttagccaggatggtctcaaactcctgaacttgtgatccacccgccttggcctcccaaagtgctgggattacaggcgtgagccactgcacctggcctttttttggtatttttagtagagacggagtttcaccatgttggctaggctggtctcgaattcctgacctcaaggcctgccttggcctcccaaaatgctgagattacaggcatgagtcccagtaagatttttaaagggataccaaaataatcaacatttattttagaaggtgactttcttcaatgagatgtcaatgtctactttctgttatatagtgctattgtttcttttttcttttttttctaagtgagggtctcactctatcacccaggctggagtacagtggcatgatctcgggtcactgcaaccttcacctcccaggttcaagcaattctttcacctcagcctccagggtagctggaactacaggtgtgcatgcctcgctaagttttgcatttttagcagttgttggccaggctggtgtactgtttcttttattgactgagatctatatttacacagcatgaaagtctcagttgcattaagtacattcgcattgttatgcaaccatcaccattatctagttccagaattttgccgtcaccctaatagagcttgtatatatgtccccaccaaatcttatgttgaattgtaattcccagtgtttgaggtggggtctggtgagaggtgtttgcgtcatggggcagatccctcatggcatagtgttgtcctcgcagtagtgagttagttctcacgatctccttactccatccacctgcttctcctaaaactttgaaatacgcttggaattgaaagtgtttagtttagattgaggatagttatctaaaagtgacatacagggctcctgctttgctcttccttagtaaatttcctattttattacacagtttactaatacagaggacttgagttttgttatttccatggaaaacattattgaatctaaatttaactagagatgtgtagttcagggagggagagtggttttataatatgaatcttggatttgaaatgaacttaaagcaaatgaataaaaattgtttcattaattataatgtctgaaataatgcatgtttttgtgaataaaaattgatataataaagtttaaagtgacaggagtagatataactaattgtatttataatttcttggaagtaaaataacatttttgaaaaatattatacaatgacctcacatacagtgacctcacttaatctatgtgaggctatacacagtggctcatgcctgtaatcccagcactttgggaggctgaggcaggtgattgcttgagcccaggggcttaagaccagcctgggaaacatggtgagaccctgtctctacaaaaaatacaaaaatcagctgggcatggtgaggcgcacctttggtcccaactacttgggatgctgaggcaggaggatcacttgagcccaggaggttgaggcagcagtgagctgtgatcgcaccactgcactccagcctgggtaacagaatgagaccctatctcaaaaaaaagaaaaaagtctatgtggaagacaccacgttaattgtgttgggtggtttagagatgtttctgtctccttcactgatgaccgtgtgtctctgctgctgtcgctcactggtgattatcaactcaacctcttatatttgttttaacaaatatttatacaccctttgtaaatttgcatgagataaagtcattatagttaaaaaaaaattttttttttttgagacagaatcttgctccattgactaggctgagtgcaatgacatcatcatggctcacggcagcctgaacctcctgggctcaattgatcctcctgcctcagcctcctgagtagctgaaactacaggtgcatgccaccatgcccagcttgttttttattttttgtagagacagggtctcactatgttggcaggctggtctctaactcctgggttcaggtgatcctcctgcctcggcctcccaaagtgttaggatttcaggtgtgagccaccatgcctgtcctatgaagtcattacaaagaaataaaattaattggtttcattggcagtattgaatttcaaagcagaaggggtgcttaagagaaataatgcctttggagtaatttctgatgctagatgaaactcatatctcatttaaggtgtccatctgaattttatgtttggatgattgtgaattattccttaaagcttgaagtgaactctggctctctaggataaattaatctttattcctttaatctttattcccttagggatatattaaagggatcaaatttttttttagagtaatgtaaaattaagggacttcttttgttaggtgaatttctcaggttttaagatatcagtatcattgtggacattgactacattgtctactaaattctgtaattttaacttataattctcagtaattggctgggtgcggtggctgacgcctgtaatcctagcactctgggaggccaaggcggcagatcacctgaggtcaggagttggagaccagcctggccaacagggtgaaaccccgtctctactaaaaatacaaaaaaatgagctgggtgtggtggcgggtgcctgtcatcccagctactggggaggctgaggcaggagaattgcttgaacccaagaggtggaggttgcagtgagttgagaatgcgccattgcactccagcctgggtgacaagagtgaaactccatttcaaaaataaataaataaataataaaaataaaaatacaaaaattagctgggtgtggtggcgggtgcctgtaatcccaactactcgggaggctgaggcaggagagtcgcttgaactcgggaggcggaggttgcaatgagccgagatcacgccactgcactccagcctgggctacaagagtgagactctgtctcaaaataataataataataataattcttagtaatttttgcaatttttttggtacctaaaataatttctgttattgtgttggataactttgtcaacttcactttgggaatatctaaatacaggtagctgcattcgagccagaggaatattgggtttttttgttgttgcttatttttgaggcagccttactttgtcacccagactggagtacattggcacaatcatggctcactgcagccttgaccttctgggctcgtgtgatcctcccaacccagcctcccaagtagttgggactaaaggtgtgcaccaccatgcctggctaatttttaaatttttttgtagggatggaattttgctatgtcacctaggctggtttcaaactcctaggctcaagcagtcctcccaccttggcctcccaaagtgctgggattacaggtatgagccaccacacccagttgagaaatactgggttttaatcaagattattgtctgaatattgagtcttaatgacttttttgattttgtttttttggccatagtatgaagtttgctgttgataaccttctgtactaactagaagtagtatagaaactgcaaattaaaaaaaaaaaacccaggtaaaatgttgatggctgctatttttatttaaggtattaataaaggaaaagaagtcagggacattatggaggtcaagttttatattattaaaactcaacttcatgatttatacatacttagaaatagtctgagtgatgtgtgaccaaaatatgatttctaggaggaatgatagttacatccgtggaatagctgcgtacactttattgttcttggtgcttaaactttagttgtcctgctaagataaaggaagacattctttcagttggaaatcatgataatgtatttctccattgaaacagtatggtttgaacagtgctatatattcatactcattattattccttaaatgaatattttaagctcctgatagaaggcaggtactgtgttatatgctgtttgtgttaccagaatacgaagatgaagagaacaaagtattacacaattcctaatctcacataaatgctatttttttttactagctgtggggagcacaaaataagtggttgaaagtcatctgacacagttacatttattcctttccttttccatggctcttaggaataaattgttctactctatggattaaattgccctttgtttattgcctgggatcccaactttatttcctaattttatttctttgaggaaacgtttcacaagttttataacaaagtataactcaatttggagagcacaatctgtgcataagttggaggctacctattgtgaaatggaaaaatgcttgtcctagcattactgagttaatgtatagctggtagaaagttttcacttttaattgctaacttgcctagtgagagtgaaagattgattacggcaactaaaaagtataaaaactactgagtagtttttaggtacagtcagttcttcagtagaacaagaatcttttttttttttttttttgagacagagtctcgctctgtggcccaggctggagtgcagtggcgggatctcggctcactgcaagctccgcctcccgggttcacgccattctcctgcctcagcctcccaagtagctgggactacaggcgcccgccactacgaccggctaattttttgtatttttagtagagacggggtttcaccgttttagccgggatggtctcgatctcctgacctcgtgatccgcctgcctcggcctcccaaagtgctgggattatgggcgtgagccaccgtgcctggcttcactcagtgttttcagttaggaaacttacattgtttagttttgggacattttcttgaattatttcactggttttttttcctctctgttttctcccgtggattccccattgcatagatgctgaattatcttgactggacctccagttttttcttcttgattctgttgccatctctttgattccttattgtttctgataaattttcctaagtttaatttccgagagctctttggaaaagtatcgattttttttcatggatggagtatctactcttttgacacagggtcttgctctgtcgtggctcactacagctttgattgctcaggctcaagcgatcctcctgccctagccctcccagtagctggtactacaggcctgcaccgccaaacctagctaacttttttgatttttagtagacaaggtctcgctgtgttgcccagactggtctcgaactcttaagcgccaagcatttctcttgcctcagcctcctaaaattctgggattacagtgtagtatcttctgtatcctttccatggacgctaatgatggggtataaaattccttttatttatttattttttattgacatcagaaattcctgctaataaaattctttttaaattttaagtttttttcttcccacagttgtccgtgtttcctccaagttccttttctattttttgttttcctttgttttctttttgtggtagatgctttcctcagatgagtggtaatccttggctatttgcagttatgcctctaaaagctgattggaagctcttagtacctcattggtacttgttgactagagttcactctagggtgatctatctgtgtcatttgctggggcacccttcatgtcagcttctgattacttttcccttttctgaaaagggagagaggtcttttaatttcctgtctggtgggaggaggtctgtatgccacttctgtgggagagtgagggaagtagggcagtgaggatttcagtattcagtacatatgtgttttcttaaggcctctgttttcattaagcctcccccgcaccaatgtgctttatgtttccctgctctgaaatcctcctgagggaataatcctctagaattttgccttggtgggaaatgcatagtaacctaaccatgtggtatttaggaaggtactgagagattgagcgtttcctaaggagctttcagccagccttctttatttagtgctcccttcacacctgtttctacaggcgctatctgttaccagttcctgagccttttgaagattccgtggacgaaggttggtttttggctttccatactgctggtttcttggatctgctatgtcagttaccatttatgcatttgctttctagcttttaagttttgtttatgccttaaaaatacctgatgagggccaggcgtggtggctcaggcctgtaatcccagaactttgggaggtcgaggcaggtagactccttgcatctgggagtttgagagaagcctgggcaacatagcaaaacccgtctctactatagaaaaattaacccggtgtggtggtgcacgcctgtggtcccagctacttgggaggctgaggtgggaggatcgcatgagcctgggatgtggaggttgcagcgtgctgagatcatgtcactgtactccatcctgggtgacagaatgagaccctatctcaaaaacaaaaacaaaaaacccccaaaaaccttattagtattttagcacaatttggggaagaaatgaagttaaatatatgtatgttccatcttctctttacccagaacttatttctaatttttttttttgttaagcatcttttttgttgtggtaaaatatacataaaatttattatttataagtatacagttcagtgacattaagtacattcacaatgttttacagccatcactactttctagttctagaacttttctatcacaccaaaaagaaaccccatacccattaagcagtcactccccattccctccctccctcagcccctggaagccacaaatgtgctttttgtttctatggatttgccttttgtggatatttcatataaatgaagtcattcagtatgtggccttttgtcacatgttttcatttaccataatatttttgtggttcatctatggtatagcatagatcactgcttccttcttttttatggctgaataattttcattgtgtggatatatcacattttgtttatctgttcatcagttgatgaacttttgggttgtttctgctttttctggctattgtaaatagtgctgttatgaacactgatgtacaattttttggggtgaacatttgtttttattcttttaggtatatagctcggtgtggaattgctggatcatatatggtaattctgtctttaacttaatgaggaactgccaatctgttttcctcagtgactgtaccattttatattcctattagcaataaacaagtgtcccaatttctccacatttttgccaacactgttttccattaaaaactttttattatagtcattctagtgggtgtaaagtggtatctttttgttttgatttgcatttccccagtaactaatgacattgagccttttttcatgtgcttgttggccatttgtatatattctttggagaaatgtctgtttaagtcctttgcccactttaaattgtgttgtctttgtgttgtagagttgtaagagttctttatacattctgggtactagacatgattttcaaatttagatacatgattttcaaatcttttgcctctagatgttttttacttttttatttttgatccttgaactcatctatattctatggttgtgatgtaatgatgacagaattggtgtcatttgtgtttatttaccaggttatttggaaggattatattttaggtgctctcctctcccccagtaaatggtattacgacacaagggttataaaggactgataagaaattacttaagacagaaagggaagttggcctgcttccaaaatgtggtcccagcagaagtgaagttagttacaccaataactacagtcaaaaagctatttttaaccatgataatgtacttgttgttattaatattaaagattatatttttccaggtgcagtggctcacatctataatcccagcactttgggaggctcaggcggatggatcacttgagctcaggagtttgagaccagccagggcaacatggtgaaaccccatctctacaaaaaatgaaaaattaaccgggcttggtggtgcgtgcctgtagtcctagctacttgagagtctgaggtgggaggatagcttgagcccaggaggtcaaggctgtggtgagccaagatcgtagcactgcactccagcctgggcaacaggacaagaccctgtctcaaaaacaaaacaaaacaaaacaaaacaaaacaaaacaaaacaaaaccgactatatttctgcattaagtgggggtatggaatcctatctaatatttgagataataattgttatagtattttattgagcttttattgggtaccagatgtgttctaagtttttttcgtgaattattttcattaatcttattcattgttgtgtcctgaatgagtactcacatatttgttgaagggctcaatggtccctaaaaccttagatgctgttttggaaggttaacttgccaaaggtcacatagttggcaaatgatgaagctgagattaacattaagatctgattccaaagtagtctttcttaactgtattgctttatgtggagttttgccattgatgtctagacagaaaatctctagcaatggaaaaaaataatttttaattaattttaatttttttagtgttttgcttcttttttttttattttgtgagccaccgtgcccaattggtttcttttaaaagactagttagcttgtgctttaggcctcttgattaatctgaggtatttaattaatatctttgaaatcctaagatttactgtatcacttctgcaatatctaaatttttccttcttacttatttctgttctccttctacagtcctttctattatgtttaatcatcaaaacgttgttcttgttttctattgcaatctaatttttagtgttatgctgtttccagatgccatttgggtcattttcaaaaaaagatgagtaataattagcaagtaatgaatattgttctttttaccattcattaagaacaattgttaattgtcttattctattgtgaagaatatctgtaattcctgcttagaacctgggttgatagcaggatatcaggaagcactaagtgtacacagaacgatatagctggaaaaagtatatatgttaaagaataatatgttgtctaaggacagaatggaactgatcacacaggttcttttttggtaagcttcaaaacttcttatctcccatgaaagtactttttcttttataatatgcaacaataactttctgtttagttaattagttttaaaacaagcttaaacttataatttataaagaatcatatttgctccctatcattgttttatagctggggctatactgacaaataagaaaaataaaattcctgcccttgtggaggagacagttaaaaaatgagacaaatacatttcagatggaaatgaggacaatggaagaagagtagagcaggatgaaggcatgaagggtgactgagatctggtcaatctttagatagtgtaatacgggaaactgctttgaaaagatgacttttgagcagagatcttaacgtactgagggagtgaaccattcgaggtctggggaaagaattcagcttcctcttcagatgtacaaaattacaagatattgccattcttgtaactgaaaacctataaaagcaggataagaagtacggtttctaaaaacccatcgaagagctgaggatacaagggagcctaaatgaaccaactccagaaagtaatcaaactttcatagtggagaagaaacccatggttgctctaggatggaacaaccaaaggaataggaatccaccatagatgaggggaaaggagaaaccagccacatttttttaaaatcagatttttaatggccacgtatgggctggtttgacaggttaggatcctaagaagccctagcaactctggcaccaaagagcaagtatgcacccacactccagctcctacccacagatgttcactgaatgttcaggagtagtaagccaaaagcctgggccagtgatgaactggcatagataatacctgaggcatttggaacctctcccaagtatagggcaaccacccttagaaggcaggattgctgagaaaaatccagcagaggctctccaggctttcagttctggaatgctgcaggcaggggaagagctagagataactctcaccccacactctggcagtccatgttttcagccaccaaggactggggacagggcagaagaggtgagtgaaactgctctaattcatttcaggccttcacagaatgtaaggaagctgccctccagaaggctggctggggaggaggagcagggctgcacgagggcacctgagcttcagaaagcaaggtgtgcgactggagagcaaggagaatctagcaaaccaaactctgaccgtcgcgcttaatgcagagatagagttcctacagttttttttttctttcttttttaaaatataaacttgaatttttgaaacagtttcagatttaaagaaaaattgccaagatagtatggagagttcccataaatgctgcctctagtttttcctatttttatttaatttatttatttttttagtttttcctatttttaacaccttatattagtatggtatatttgttataattaatgaactaatactgatatattttcattaactaaagtccatactttatttacctaatgttttgggatcccatttagctgtcacgtctccttagggtcctcttggttttggcattttcttagacttgagcttctcatctcttgtttttgatgactgacagttttgaggagtattgttcaggtattttgtagaatgtccttctattgatatctgtttggtatttttgtcattgttacagtgaggttttgtatttttgggacgaagaacatgcaggtgaagtacaatttgctttcctttttttgagacagtgtctcactctgtcacccaggctggagtgcagtggtatgatgacagctcactgcagccttgaactcctgggctcacatgatcctccctccttagcttcctgagtagctgggactacagatgcatgccaccacacctggctaattttttttttttttttaatagagacagagtctcactgtattgcctaggctggtcttgaactcctaggctcatgcaatcctcccacttcagcctcccaagtagttgggactacagacatgtgccactatgcttggcagtaccattttcatcacatcatattaaggggacatactgtcaatatgactaatcagtgttgatattgaccttgatcatctggttgaggtagtgtttgtgtatttctttactacaaagttactcttttttctcctctgtttacatactgtactctttggaaggaagttacatatgcgcagcctacacttaaggcatggggagttatgatacccctcctcaagggcaaagtgtctatataaattatttagatttcttctgcatggaagatttgtctcttcttcctcatttatttatccattcaattttttaaatattagtatggacttatggatattttataccttgggttaaaatcttattattgctttatttattttattgttcaagttgttccagctttggccactgggagctctttcagttggtatgactttttgatataccactgtcagtgtatgtgtgtgtatgtctgtttgcactttctcactttctggcactacaagatgctctagtatatttagagactaaagcatgtagtatatgctttagtatatgctttatctagtatatttttctgtctcaatcctagaattagccatttctccatggagccttggttccttttactggagaatggagaaaccaagatctaggtgctaggtgtacatgttgctactggggtgtttttgcttgtaggccatctcagctgacagagccagaaaatgtatgtatttatactaccctgtatatatccacatatctataaatatttctatatgtatccatccgtatctaattaagctaaacatgagtttatattgatgtattaggttccagttgaatcactacatggatgattctaacttcctgcccttgcttatctgaaaactcctgctccaatagtgagaaatctgtctcctaccatcagccacccatttacttaatcattctactctagtatacatgtaaggtactcccacagttttaaaaactggtggcttggctatgaaacacaagcaggtctctgtaattttacctaggctcagatcccagacctgctcaagtgaaaggcttgatctcagtccttaaatatttgaagccagtgattaactgttaaattaaagctgcatcatagcccacacccagctcagttacatattggattgactcagactcccttctagtgtcctaacagaaaaattgtcatgtctttttctggaagtaaaatattacttaatttaataagtaatctatttttatataaaatgtctggtgtgtaatgaaaagttacaaggcacaagaaaagcaagaaaatgtgaccaaaggtcaagagaagaaatagtcagagatgatccagatttatcagaattatcagacagggatttaaagataattatgaaaaaaatgctagatgattgaatgataaaggttaacgatatgcttgaaaagatggggatttctgtagagtcatggaaattatgccaaagaaccaagttgaaattctattaaatagaggtgaaaaatatactagcagagaccagggaaaacaaaaaaaggaaagaaaagaaaaggaaagggaagggaggggagggaagggagaaagaaaaatacactagcagaaatgaattcattacatgggcttaacagtttatggacatagcagaagaaagaatcagtgaatatgaagacagattggaaagagaaaagacagaaaaagtcagggaggggtagaaaagagattttagatctgtgggataatatcagatggtctaacatatatgtaattggagtttcagaaggagagaagagaacgtggcagaagacatatttgaagaggcaatgctcaggaacttctaaaattgatgaggtcatcaattcacaaatggaggaagttcagcaaatcccaagcaagttaaatacaaaacaaaaataagccaacaaatttaaaaatcccatatataggcatatcataatcaaactgctgaaaactgaagatggaagagatcttaaaagcaacaggagagcaacaggagaataaaagacacattagttatgtgagaatggcaacatgggttatggctattccatgttttagggccagaaaaaaatggagtcttagctgagcatggtggcacatgcttgaacccaggagttcgagtccagcctgggtaaagtagtgagaccccatctctatttaaaaaagaaaagaagtccaggcacggtggctcacacctgtaatctcagaactttgggaggtgggcagatcacaaggtcaagaggtcgagaccatcctggccaacatggtgaaactgcgtctctactaaaaatacaaaaattagccgggtgtggtggtgcacacctgtagtcccagctactcgggaggctgaggcaggagaatcacttgaacccaggaggtggaggttgcagtgagccgagatcatgtgccactgcactccagcctgtcgacagagcgagactcagtctcaaaaacaaagaaagaaaagaaaagaaaaaatagaatgttaaatacaatgggatgacatccataaagagctgaaagaaaaaaaaaaaacaacctgttaacctagatttctatggccagcagaaatagccttcaaaaataatggcaaaataaagactttttggacatatcaaaaagggaaagaatttgtttccagcagacctggactcaaaaaacattaaaacatacacattaacaagatgtgggttttacagcatatatgtgattatacaaccatgaaagaacaaaaaggaggagatggaattatactgtcacacatttcttactctgtgaaaggagactgtagtaacttctggatgcatatgtaatctctagaacaagcactaaaaacacaaacagggataccataaagtcagtacatctgcccaagagggattaactgctacgagaatcattctcctactgtaaacagctagaaaacaggacaaaaatacatgaaacaactgttttcagacattggacaacaggcagcacaggatagtgatccctgagagaagggaaataactgatatgaaccctacaggggttcctataggcagtttccagattgtagcacagagtaggggaatccaaatagagcccaggagagtttggagaagtcaaggcaactagaatttgtggggcagaaaacaagaataaaaggaactacacagaaatctatagaagtaagagaatctttgattggacactcatctgcacatgtgaagtgtggaagtcagcaatgctggagaaagtcacactggaaatcagaacactgaacaattccaggagctcacacagagctgggaatagtttatgtttccattaggcatagtggagagactgtttcatacaaaggacattggctagagtcttcaaagtggggttaaattagctatagactaaaggcctttctaaacctaccctaagcttcaaggcaggttttgaaaggaccaggctgattctaagtaactcaattatgtgccaaaactaaactcttttaaagaatacagtaaatgccagcacctaacaattaaaatgttcagcattaataatatattaatgaaagattactaggcatacaaataaaaagcaggaaaatgacccataaccaggagaaaaatcaatagaaaagagacctagaaatgtggaattattagaaataattctgatgattgaattatcagccaaatatgttaatacaagtattataatgactagtagagaaatgaatgatagataaaaagacacaagccagatgtggtgaatcatgcctacagacttgagggtaggcagatcagcttgcccaacatggcaaaaccctgtctctactaaaaatacaaaaattagctgggtgtggtgggatgtgcctgtaattccagcttgggaggctgaggcacgagaattgcttgaacctgggaggcagaggttgcagtgagctgagaacatgccactgtactccaacctgggtgacggagtgagactttgtcgcaaaaaaaaccaaaagactcacaagtagtatctaaagatgaaaaataccagatataatatccaaaactgggggaaaaactggatgtgattaacagcagattagacactgcggaaaaaaagatcattaaatgtgaaggtatagcagtagaacctattcacactgaagcacaaagagaaaaaaaatactagaacaaagttaatagaacatcagtaaccttgggacaatagcaagttgcctaatacatgtataattggagttccagaaaagtggggaaaggtagaaggcaattactttaggaaacagcgtctgggtggccaggtgggtggctcacacttgtaatcctagcactttggggggccgaggggggtgcagatcatttgagatcaggagtttgagaccagcctgtccaacatggtgaaatctcttctctactaaaaatacaaaaattagctgggcttggtggcatgcgactgtaatctcagcttcttgggaggctgaagcatgagaattgcttgagccagggagatgtaggttgcagtaagccaagatcatgccactacactacagcctgggcaacagagtgagaacctatctcaaaaaaaaaaaaaaaaagaaaaagaaaaagaaaaagaaaataagaaaatagtggctcatcatggtggctcatgcctgtaatcccagcactttgagaggctgagatgagaggattttttgagcacaggagttcaagaccagcctgggcaatttccttaaaaaagaaaaagaaacagtgactataaattttccaaatctgatgataaccataaactctcagatccaagaaactcagtgaactctaaatagaataaacaaatataatcatacctaggtatgtaatgataaaattagtgccagtcatggtggctcatgcctgtaatcctaacactttgggatgctgaggcccggagtttgagaccagcctgggcaacatagtgatacccctatgtctacaaagattaaaaaatagaaatataaaaagttagctaggcatggtggcacttgtctgtaatcccacttacttgggaggctgaggtgggaggattgcttgaactcacgaggtcaaggctgcggtaagccataattgtattccacccagggtgataaagcatgacgggagatcctgtctcaaaacaaaacaaaaccaaaaaaaggcgaggcacagtgactcacacttgtaatcccagcattttgggaggtcaaggtaggatgatcgcttgagcccagaaattggagacaagcctgggcaacatagtgagaccctgtctctcaaaagaaagtttaaaaaggcgggcatggtggcatgggcctgtagtcctgtctactcaggtggctaaggtgggaggattgcttgagcttgggaggttgaggctgcagtgaactgtgttcgtgccactgcactccagcatgggagacagagcaagatcctttgtcaataataacacataaaccaatgttacaatgagaagaaataaattctggtgttcggttttttgttttttttttttctgagatggagtttctctcttgttgcccacgctggagtgcaatggcatagtcttggctcactgcaacctccacctcctggattcaagatgattcttttccctcagcctcccaagtagctgggattacaggtgcatgccaccacacccagctaattttcgtatttttagtccatcacgttagccaggctggtctcaaactcctgatctcaaattctggtgttctattgcacagtggggtgagtatagttaagagtaaaatattattacaaaatagctggaagaggggcttttgaatgttctttcacaagtgagaaatgcaggaggtgatggatacactaactgctctgattggatcattatgcaacatggatatgtatcaaaacatcaaattgtggcccggcgcggtggctcatgctggtaattccagcactttgggagtctgcggtgggtggatcacctgaggtcaggagttcaagactagcctggccaacatggcgaaaccccatctctactaaaaatacaaaaattagctgggtgtggtggtgcatgcctgtaattccagctactcgggagactgaggcgggagaattgcttgaacctgggaggcagaggttgcagtgagctgagattgcgccatcgcactccagcctgggcaacaaagcaagactccatctcaaaaaaaaaaaaatcaaattgtaccccataagtatgtacaattacaatatgacagtttaaaaattaaattaaaaaaaaattctcttgtacttaccagctgaataaaaaataaatttttaaaaggagagaagtcttcttaaaaaccagttatttaccccatcattaagttataatgaactttcttatgggaattctttgataaggaagctcctttatgctgaagttttattcttttcatacctctttagataaatcagtgctttaggagcatatgtcatatgactcaatggcagtgttctaacttggattctagctccacattgtgcaaaggcaaaaaaccagagagtcagtgtggtagttaagaacttatgttctgctgtttgatttcctacatgccagtactccctccactacctgcagtcttcctgacctggggcaagttccttttgtaaactctgttttctagggggatggtggtggaagaaggatggtgatttgagccaggcagtagcaggtagaggtggagaaaagtggtcaaaccctgaatgaacgttaaagataggaccaaaaggatttgatgagaaattggaagtagagcacagggaaaaagaaagatatcagtgatgatgccaaggtttttggcctggggaattgggatagtggagttgttatttgctgagtatgacttttcacaaaggaatgtcaaggcataagtagcaaagttcttttttttttttttttaatttttcttgattgtgtttgttttgtttttcatcttttgtgggaggtgggtggagatgaaagcaagcacaggggttggcaggcatacccctggcacctacctgtgagttcatgattactagttttaaagttcagtcctttttatttttacttttttttttttttttttttttttagagacagtgtctcactctgtcatccaggctggagtgcagtggcacaatcacggcttactgtagccttgatctcccaggctcaggtgatcctttcacttcagcctcctgagtagctgggactacaggcacataccaccctacccagcaatttttttaaaaaattttttgtagcgacatagtcttaccatgttgcctagactggtctcgaactactgagctgaagcaacctgtctgcctcagcctcccaaagtaaagtactgtaattacaagcttgagccaccgtgcgtggccaaattctggccttttgatgttgcatggtgtggatggggaggcaaagtgtgatattttaggaatttgaggatttcttcttcgaccttaggcgtgacattggacaaatgacatctgggctgagacattttctagtaatgctggatccaaaaaactcttatcccattgtctcatagcttcattacacagacctggcggccatgatcctctttttttcccccttagttgccaaacatgggttctctgtcttacctcatttgagtcttacctcagtcttgagagtctcaaatgtgtatcatagtttttagacaaaattcaaccttatttcaattagtatttcattgttatttaaatattttaacaggaaaactgagcaatgtttccctttacctgttaatcctgttataatattttagataaagtgtattagaaggcacattcttcattaatagaatatttattcatgtgtttatatggttcttaactaggaataccatatagtctatctccaaccctttgagaaggaaaaaagatcctgactaaacaggacaccagaagggcatgcctaaactaggactgttctgggcaaatcagaaggcatgttcaccttattctttttattctttctttttctttttttttttttttttgtgacggagtctcgctctgtcgcccaggctggagtacagtgacacgatcttggctcactgcaacctccacctcccaggttcaagcgattctcctgcctcagcctcctgagtagctgggactacaggcacatgccaccatgcctggcaaattttttgtgtttttagtagagacgggggttttgtcgtgttagccaggatggtcttgaactcctgacctcatgacctgtccacttcggcctcccaaagtggtgggattataggcatgacccactgcacctggcctcaccctattcctaaggccagaaaaccagctagagtaaagttcactttctgtttgagtgcttggactttattgggagaaggcaaatgccctggaacaagagtgaaagggagaaattcccgttgtattgcaagccagaataagagaggctcacccacactggcctaaggcatctcagttgttgatgagaatgtgattacagatgtctcacatgaataccaaagacaattgcaaaggaaattaaaagttatgcaaagagagtcgagaagtcagttgtctgctcacaggttggctttagtggctattactttgagatactaaatgagcgatagctttaaacttcaactgcttttgtttctgaggaaaaaaatcatcttatatcctttcataagtcgcataaaaagtggacattttctattattttaaagagtaaatttaggtacaagcatttactaatttttttttttttttttttttttttttgagatggagtctggctttgttgcccaggctggaatgcagtggcgcaatcttggctcactgcaagctccgcctccctggttcacgccatgctcctgcctcagcctccagagtagctgggactacaggcgcccgccaccacgcccagctaattttttgtatttttagtagagacggggtttcacccttttagccaggatggtctcgatctcctgacttcgtgatctgcccgcctcagcctcccaaagtgctgggattgattacaggcgtgagccactgctcccggcctgtaattctttttttttttgagacggagcctcgctctgttgcccaggctggagtgcagtggcgtgatcttggttcactgcaagctccgcctcccgggttcacgccattcttctgcctcagcctcccgagtagctgggactacaggggcccaccaccacgctcggctaattttttgtattttttagtggagacggggtttcaccgtgttagtcaggatggcctcgatctcctgacctcgtgatccgcccgcctcagcctcccaacatttagtaattcttaaaagagttcagcatgaatatacacagtacgtgggttattagtactgtgttgttaacacaaatgaactatgatagcaaattgaatttggttcaatcaggtcaaagaataaaaggatgattttctttaaccaccagcaaaggatagtataatgaaccccatgcaactatcacttaacttcaataatttcaagtttgagtaagttgcagagtagtaatttgaacccacatctctcttgttccaaatcccttgcttttaattacaatcccatgtggcttctttgtcatttgatgctattgagcaactttatgatttttttggtgtttttggtaaaatagacatgaaaaggcattactacagggagttttttcactccctggtaataagaggggaaaagcactctcttttaatgatacatgttttgtaataagcattttttttagttgcagtgttctgcaaagacaaaacctgctgatacagttcatcctgttttagaaatctttgacccattcatcagactctgaccactctaaagataaaggattatggttgtattggtttttccgactgaagcggccttctgcagattgagaaattgtataattattaactgcggtaatggagatgtacttgcaagtttcatctggtatcttaatgacctttaaccctctgagtacacctaaaacatatcctagaattattgaaattaatcagttgtccataacttttctgtctgtataatttggctatcatacgtattttgtttccccctgcccttgccagtttccatcctcctactcacatactcacaactcctataaattggagtatttagtagcagtagcctttggtataaacactttttaaaaatttactattttttgaattaatagggccactttctagtcaagtttttttttttttggggggggggtaaggagggtagggtaacagttccacacttacaagggtatttgtttagaccaagcttgttcaacccacagcctgtggggctgcatgtggtccaggatggctttaaatgcaactcaacatgagtttgtaaactttcttaaaacattatgagttttttttgagaatttttttgagacagagtctcgctctgttgtccaggctggagtgcagtggcccgatcttggctcactgcaacctccacctcctgggttcaagcgattctcctgcctcagcctctggcgtagctgggattacaggtgtgtgccaccactccaagctaatttttgtatttttagtagagacggggttttaccatgttggccaggctggtctcaaactcctgacctcaagtgatctgcccacctcggcctcccaaagtgctgggattataagcatgagccaccgcgcccagcctgcgatttttttttttaagctcattagctatcattagtgttaactgtattttatgtgtggcccaagacaattctccttcttccgttgtggcccagggaagccaaaagattagacacccctgatttagacaaataagtgaaggcacactgaaataacagttatatataataaccttgtgccacccagcgcggtggctcatgcctctaatctcagcactttgggaggctgaggcgggcggatcagctgaggttgggagttcaagaccagcctgacttacatggagaaaccccatctctactaaaaatacaaaattagctgggcatggtggtgcatgcctgtaatctcagctacttgggaggctgaggcaggagaatcgcttgaacccaggaggcagaggttgcagtgagctgagatcgcgccattgcactccagcctgggtgacaaaagcgagactctgtctcaaaaaaaaaaaaaagaaaagaaaagaaaaaaaaaacacaaaaaaaccttgtgttttgtggatctcacattcatctcagatatttcttgccctgggagatcctctgaattctcaggactgcttcgtgtcatccctttatgctctactatcttcccttgcctagaaggcaagtagggctttgaatctcgcctttgattctactgtgatcctatcaaatatagtaatgctagaaatataggtctgaagtttgggagagagattggctcagtatagatatgtaaagcacagctggatatgtagtagttatatgaatgggattggatgaaattctctagaggtgtgtggaatggaaagaggtggcccaaggaggaagagagagagagagaaattggagaggtagaacaatttaggaaagagtaatgttctagaaactaaggagagagtttcacaactgcagtggtgaagcactgtgagttcttatttggcaatttggacttcattattgtcttatcacagataggaaatgaaaggttgcagaacatttaggagaaaatattaagtgaggacacagaagcagtaaatgtcgtatatgccttttaaacattttggagattacccatagtaggcctgtcccttgggtaaggcaattagggcagctttcctgggccctattttggggtggggaatgactcggggactttattatatgactttttttctgaacattaataaaattcagttccaaaattttgtgattaactgtagtcctaagagcctatgaaaaatgcagataatgggcagttccacattggttgaactgccccaggcttctctcttctagagatgctgtcccttccttttaatcctgtagtagctcctatcacttttttttttttttttttttttttgagacagagtcacccagactggagtgcagtggtgtgatctcagctcactgtaacttctgcctcctgggttcaagcgattctcatgcctcagcctcctgagtagctgggattacaggtgcgtgccaccacacctggctaattttcgtatttttatgggattttaccatgttgcctaggctagtcttgaactcctgacctcaggtgatccacctgcctcagccgctgaagtcctgggattacaggcgtgagccaaggctcctggcctcctgtcactttttacaattgtcagtttgtttttcctctcagaaattaagctccttaaagctctctattattgttttgaattcccagggcctagcataatgcccagcacgtaatgttgagtgtttgttatgtgagtgattgaaggaataatccaatacatatctgtcttaagtacaaaagaattccaatatggtggtctcacagagtcaaaaaagcggaatgtttcagaaaagagggattgataaacagtttcaaatggtactaaaagtattgaaaactgacctttggatttggcttctagaaggtcattggtttccatagtgaaaacttttatagcaaaatggttggagtagaagtggttgaagattaaaggagaaatgagatgtaagaaacaacaaacaagtttgtgggggcgggggggttggttttatttttaaagacttgtagctgagcgtgacagtatgtatctgtagtcccagctatttgggaggctgtggctggatgatagcttgagcccagcagcttgaggctgcagtgagccatgattgcaccattgcactccagcctgggtgagagagagagaccctaactcaaaaaataaaataaaataaaataaaataaaataaaataaaataaagatttgaagctaaagggaagaaaccattggagaagaaagccaaagatctgatggaggagaattcattatcatggtaatgttatgcatttgatttgcatatatctaagtattcccaccaacatgttttttttttttttttgagacagagtctcactctgtcacccaggctggagtgctggagtgcagtggcacgatcttggctcactgcaacctcccgggttcaagcgattctcctgcctcagcctccctagtagctgagactacaggctggtgccatcacgccctggtaatttttgtgtttttagtagagatgaagtttcgccatgttggccaggctggtctcggactcctgatctcaggtgatcctcccacttcggcctctcaaagtgctgggattacaggcgtgagccaccacgcctggtcccaaccaacatttcaagataatatatttctccttccacttgggtttgatatattaatgtattttgaacttgaaggcttttgctgtgctatttggggcccctagtggtaaatctaataatgacatgcaatagaacagctaatataccagttattccttatgaaggttattctttctatgaggattaaatgaggttggaatatgtagttatagcaatagtagtgattcttaatcatttttttaaaaagagagtctcgccaggcacgttggctcacacctgtaatcccaaaactttgggaggccaaggtgggtggatcacttgaggtcaggagtttgcgaccagcctggccaacatggtgacaccccatctctactaaaaaaaactaaaattagctgggcgtggtggtagacggctgtaatctcagctactcggtaggttgagaattgcttgaacctgggagacaggaggttgtagtgagctgagatcgcgtcattgcactccagactgggtgacaagagcaaaactctgtctcaaaataaataaataaagggtctcactttgttactcagactgaagtgcagtggtgtgatcatggctcactgcaatgtccgcctctcaggctcaagtaatcctcccacctcagcctccctagtagctgggactataggtgttccaccactatgtccagctaattttaagaaattttttagtttttaaatttttttgtagagatggtggtcttactatgttgtccaagctggcctcaaactcctggtctcaagtgatcctcccacctcggcctcccaaagtgctgggattaccggtgtgagccaccatggctggccaaaaatgagtaatttttttttttttgagatggagtctctctttgtcgcccaggctggagtgcagtggcgaggtcttggctcactgcaacctcctcctcctgggttcaagcgcttctcttgcctcagactcccgagtaactgagactataggcacgggccatcacagccggctaatttttgtatttttagtagagatggggttttgccatcttggcctggctggtcttgaactcctgacctcaagtgatccacccccttggcctcccaaagtgctgcgattacaggcgtgaaccactgtgctctgccccaaaatgactaatttaaaggtgactgtaatatagttaaacaaatgcctcttttcccattctttactaacttgttatttaaatggggcaagtttttacaacataagaaacaggccaggcgcggtggctcacgcctgtaatcccagcactttgaaaggcagaggcgagtggatttcttgaggtcaggagtttgagaccagcctggccgacatggtgaaaccccgtctctactaaaagtacaaaaattagccgggcatggtggcacagactgtaatcccagctaatcagggggctgaagcaggagaattggttgaacctgggaggtggacgttgcagtgagcctagatggcaacactgcagtccagcctgggcaacagagcaagactccatctcaaatgaaacaaacatactaaaaacctattaacttgtttgatgtgagtgtgcttagctttatttcccttaaagagagtctttttatgagatggagtctcactctgttgcccaggctagagtgcagtggtgcaatctaggctcactgcaacctccgcctcctgggttcaagcgagtcttctgcctcagccttcaagtggctgggactacaggcgtgtgctaccacgtccagctaattttttgtttttagtatagacggcgtttcacgctgttaggcaggatggtctcgatctcctgacctcgtgatccacccacctcggcctcccaaagagctgggattacaggtgtgagccactgcgcccggcctaaagagagtctttaggtgaaaaatttttgtgaatattgtgatttctccttaataatttcttgtgtatttatgaattttatataattaaatggcatatcaaaaaaatcacctatgttaattatgtttttgactcagttatattttcttttggtacattattaagttaatatccatatgcaaaaatatgctgacaatatattaattttggatttttcatttttatcagaaatcatgagtggaggatctcaagtccacattttttggggtgctccagttgcttcactgaaaatgacagtatcagaagacacagcttctttaatgtctgttgctgacccctggaaaaaaattcagcttttatacagtcaacattctttatatctgaaggatgaaaaacagcacaaaaatcttgaaaactatgaagtcccagattctattggttctccagatctttgtggtcatttcttagcaaactgtatgaatagacatgttcatgtgaaagatgactttgtacattctgtttctgaaacacagaatatagaatcccagaagattcactcctctagactgagtgacataactagctctaatatgcaaatatgtggatttaaaagcacagttccgcatttaaccgaagaagaaaagtatcaaagcttctcagtgaaaataaaattagagatgaacagcctaaacatcagccagatatatgtggtcagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaactcagtagataagtcaaggtctgaagcagcagttaagaaggtctcagaccttaaaatatcaactgataaagaatttctcagtataattacctccagccaggttgctttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacatattgagttgtgtagctcaggaatactgtgttcccaactaaataccttccacaaaagtgctattaaaagaagctgtacctctgaagataaagtgggccagtctgaagctctatctggagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacaaaattcggaccaaattctggctctaaagtgcctttagcaacagttacagtaagtgatcaatcagaaactaagaagaaggtttttctgtggaggactgcagcattttgggcatttacagtgtttcttggagatataattttactcacgggtgaggtcattatggtatagtggtagcttattttataaagctaagttttgtttgtttttgtttttctcccacttagtctttgaagactctttctttagtcatttgcctcttctgagctcagcataattgatccctttattgcatctgcattgctctcctttccattgtccactctcctgcccattgccacttctgggcctctgttctatccttctcagctctgccccttctttccacttatcccctcctttaataagccttccctagtcaggtggagtgggtcacacttgtaatcccagcactttgggaggctgaggcaggaagattgcttgaggccaggaatttgagaccagccttggcaacacagaacccgtctctacaaaaaataaattaagttttgcgtgcctgtagtcccagatacccaggaggctgacatgagaggattgcttgagcccaggaggttgaggctgcagtgagctttgattgggccactgcactctagcccgagcaacagagttagacctttctgcttctttacctaatgtctaataatgctgtgcacattgtgtttttactgtgggaacagttattgatttctgttgccttattttattatcaaaattatattaattacacttggaaatatggaaaggaaaaaactggtattataccaacttcatataaccaccaatagagttcgagagtgttgccttccagttattttctctgttctccttaaaatgtgtgtgcatgtgtgtatatatcacacatagaagctcatatttattgggagcttagtttgtgagaccctgttttagattttacatgcatatttcattacaacaagtatatgaggaaggtactgatttttatccccacttttcagttgaggaagctgaagcccagagaagtaaagtaacttgtccaatgtcatacatctaggaagtggcaaagctatagtttctcctagactccagaatttatactcttactatatagttgtaaccataaagaacattttgtttttttaatttttaatttatttatttttaagagacagagtcttgctatgttgccaagtgcagtgggtactcacgggcacaatcccattactgatcagcatgagaatttttgaattgttatttttaattttttgtttgtttgtttaataaggacaggatctcactgcattacccagtctgatctccaactcctgggctcaattgatcctcctgccgcagcctcccaaagtgctaggattacaggcgtgagctaccgtgcccatggtatttttaacatgcccttgtttccaacctggaccagttcacccctccttagggaacctgtggtcctccactcccaggaggtcactatattgatggcaagcttagtgcaaacacctgatcggctacaactctgaactcctgggctcaagtgagcctcctgcctcagtctcccaagtagccaggactacaggcacgcatgccgctgcacccagagagaatatttaatttttttttttttttttgagacagtcttgctctgtcacccaggctggagcgcagtggcacaatcttgactcactgcaacctccgcctcctgggtgcaggtgattctcctgcctcagcctttcgagtagctgagattacaggtgcaagccaccatgcctggctaatttttgtatttttatagagacggggtttcaccatgttggccgggctggtttcgaactcctgtcctcaggtgatccgcccacctcgccctcccaaaatgctaggattacaagtgtgagccaccgtgcctggccagaatatgttttcatcgaacacatctaacattgtgttacgtgttctttgttgatttaaaattgacacatggtgtattagagcaggaggaagttgattaagcttaataaaatatctaaagaaagaatgtgatacagaggcggtatttagaaaaagaaaacttcgaagcaatattgatagtcctaccaaatagtttacaggaggaatgagaaccttagctaatgtacttggtgttcctgtaggattgtcaagtacaatctttttttttttttttttgagacggagtctggctctggcacccaggctggagtgcagtggcgcgatgtctgctcactgcaagctccgcctcccgggttcacgccgttttcctgcctcagcctcccgaatagctgggactacaggcgcctgccaccgcgcgcggctaatttttttgtacttttagtagagacagggtttcactgtgttagccaggatggtctcgatatcctcacctcgtgatctgcccgcctcggcctcccaaagtgctgggattacaggcgtgagccaccgcgcccggccgagtacaatcttttataaagaagtaaacacaaaattgtaatgaacaggcttagcatagccacatcccactggcagtattagctaatattatttatatgtgattatattattggaggttcaattcacctaactccctctgttctgattcagtgcttgctgaatacctctttgcttgtgatttggctttctagttgtagagctgcccacagcatgagaacaggctgaaatactgtttttttggggcaattattgtaaatgaaaaaaaaatgtttttttttctttaatttgtttcattaattgatttagtatgagcttatgttgcagagctgaaatctagttttggagtgttaacaaaattaagtttcccagactgtaaaagagggctggatcctggaccatggtcattttaccgaggcaattaatgtcagcagggacctctcaggggccttttcctttttcctaggtaggtgtaaactcaactctgcaatctctgtattttttcctaacatctctatagttgttaacgactaggtaacattctctctggtggctgtaatgcaatttacttaaccattttcctattataagacatttagatgatttctatgaacatttttttaaaaaatcagattttttttgtctttttaagaaaaagaggatctagttcaccgatttctgaataagtttcttttgtgtggaacagatggaaatgttgggaaaaaaaagaaatctacacttttctgttgtcctaatgaggcagtgaacttagttggatagcttgggtagtttatactacctattgatatatacccccaaacagaaatcttcctttttttttttttttttttgagatggagtcttgctctgttgcccaggctggagtgcagtggcgtgatctcggctcactgcaacctctgcctcctgggttcaagtgattctcctgcctcagcctcccaagtagctgggactacaggagcccgccaccacgcctgactaatttttgtatttttagtagaggcagggtttcaccatattggccgggctggtctcgaactcctgaccttgtgatctgcccacctcggcctcccaaagttctgggattacaggtgtgagccagcgcgctcggcccatactgaaaaatttgaagtaacagatgtattccagaccttgttgaataccaacacagtagacagtttgctattataacttctagcaatagaatgaagagatgccaaaaataaggattacctaagggagactactgactagaattagaagaagatgggaggcttaacattgggaaaccacagtgtttaaaggacaaacagaataaggactaggagctggggcatgtcagtgagagggtaggaaggagccaggaggccagggtgggctacccatcccctccatgcaccactagtgattaccatgtcactaatccaacataggcttcacagtcctagctttcagaatgctctccttgaaatttcttgtctgttccttttttctgaagaacatgcatcctgaatgttggatcatgaaaagtcttgaatgctgtactagctcttcctggctaggcagtggggaaccactgttttttagtaagtcacctgaactcattaatgctctgatatatcactcgcctgaactcattactgctctgataaatgactcattagcattgtaagaaatgggttgcaggcgggacaagcacctgttgggagggaaaggaatgtgtaatgtaaaacagtagtagtggtggggcatgggcacatttaagcagcagaggggtaggtgggagctggtggcaaggagtgggaagggagaggcaagatgacttcagattttagtttacttgattagcagcatagcatcaataaatgagttgggcgctatgaaaggaaaagcagatttggacattgctgagtttggggagccaatggaatatccaggtgggaatttccattaggcagttgtagataaaaggttcaaaagctgaggaaagggtctggaatctaaatctgtaagtaatcacttggaatttatacatccttggttttctttcctattatctctaaattatttcactattgttaatatatgtttatacctctgacactgtatgctgattagatcctgccttagagatagctcccttcccctctttctctttacagctcacatgttttgctctacctacaattgtttctacctgttggtatgtttagttctacctgattctactctatccgtcttagatatacagctctctctttccaattggaaaatgttccctacctccaaagtctttcacttttaacttatgtggaagataattatcgtgctatttagggaaaaataatcaagtgtgttatattcagatatatttatagtagaagggaccagtgcatactgaatattattactctcctaggcactacggctttggaaccactactttgccttctggtcctaaaaaaaattatttttgatgtatcagaaatatacatgataacattttccttatgtaaataaaaactattaaaccttttttatatagagcagtggacttccatactgctatcatttgaatataaagaagaaattttgttaatttacctagatttagattttagatttgctgttttgtcatttcgtgcccttaggcaggttatttaacctatttgatctctagttgcttggtatatgggaggcatgcataatattttgctgtgactagtaggttaaccacattgtgaaggaatttatggcatgatcagaatgttttttctctctctagatgttgttattcatgaggaccaatggattggtgagacagtactacaatcaacatttagcagtcagttattaaatcttgggagttattcatctattcagcctgaagaatgtaaggcacattttaaatgaagtaatgtattagtgtttaaagtataaaaacatactaggaaagattagggttaaaatggttcttttacaaaatgttttctaaacagttggagagtattggtttcttttcattagtaagaatgaaaatagaattttaagaaatgaacttgtacattgtaaatcacatttattttaagaagtattgggtctcatgtttcgttttcttaggctgtcagtatagtggtggttcttcaccttttagggagtcagagacctctttgagaatctatagaccatttctccagaaaactggacttatgtagataggcacaaaattttgcttataattctaaagcattccgtggacctctgaagttcttctgtggaacttctgagcctctgattaagaatccttgaggtaataaaaatgtattggtctcgtattcagacagctgtggtttgaatccttattctcctgtctaccactgctaagaaaagctatttttcttctttaatgtccagttttctcttctttaaaagaagctgtttaatgaggaaactagcagctatctcctcctctaggaaataaaataacataaaaaaaaagaaagaaaacaaagtaagggaaacagtataaacttgtggttttggtcactggactcagatagaccaggatttgaatcctggccctcttacttccagtctttgtctttaggcaagttatttcacttcactatacctttatctccttttctttgaaatggagataaaaatacatatataccttatagggttgttatgaagattaagtgagaaaatgaatataagatgttgaacctgcacataatgtagtagtaacatagtaatattagagggagaaataataagctagcaaaatatatttgataaaatgctgaaatatcatacaagaaaatagctagagaaatatactgattatacaagaagataactggaataataggaaagttataggatgtatatggaagatagagcatggaattccaatctttgaattcttaaagaaaggcagagcaagtagaagggaagagcaacaattagaataacaagaactgtgtttgggatgggcaaggtttcattatatactagggtggcccatcagcagaaaaccaactctgacatatttcatagacaactcaaatagagttcttcatctatccaatatatatttattatgtgttgacattgtttcaggcactgtgtttactgtacactgggggtacaatggtgcctgtcctcctggagcttatgttctcatgtggaagacagaccaaaaaaaatgaatgaaacagacatataagtaaaatatttgcaggtgataatgagtgctatgaaggaaactaacaaagggttaagatacagaatgccatggttctagttgagaaggattgatcatggagtagaatcagggttaggaagttgttacaatagctgcagttgagagataatgggaggccagtggagctaaagagccgagatatatttgtaaatagagttaataggattttctgatgatgtgggtctggggatcaggtaagagggacaatctactgctactggattactggtttaagtaactaggtagcctttattgggaaagactgagagggaactggtttgtggggaaaagggctatgtttcaaggcatgttaagttttagatatctttgagatattcaagtggagatgtcatataagaactggaaacaaagttcaggactcagaagacaggtttaaaattaagaggcaaattttagagttattagcatacagataatatttcaaatttaaaagtttttaaaataaatattatctgtataattatagaatcacaggggattgcaaaaataatacataaagtcccatgaactcttcttctagcttctcccaatggtgatatcttatataactttagtacaatatcaacaacaggaaatcaacatttgtataatactgttaactagtaatatactaggatactttccctttcagtatcaataaatatagtatcagcctggcacagtggcttatgcctgtaatcccagcactctgggtggctgaggcaggaggattacttgggcccaggagctcgacaccagcctggatgatatggtgaaacctcatctctactacaaatatggaaaaattagccaggtgtagtggtgcacacctgtagttacagctactggggaggcttaagtgggaaagaaagttgaggctgcagtgagccatgatagtaccacagcacttctgcctgggtgaccagagtcagaccttgtctcaaaaaaaatttttttcttaaataaataaatatagcatcaatacagcattataatatgattaatactatatcaataaaatagatacttagtcctaatgccaatgtcttatttaatagaaaagcactcgaggcattgtcattaaaaccaggaaaaagataaggatgtccactatctctgcaactattcatcttatactagaattatcagctaatgcacttagacaagaagaggcatctggtctggtgcggtggctcacgcctgtaatcccagcactttgagaggccaaagtgggcggatcacttgaggccaggagtttgggaccagcctggccaacatagcaaaaccctgtctgtactaaaaagatgaaaaattagccaggtgtggtggtgcatgcctgtggtcccagctactcaggaggctgaggcatgagaattgcctgaacctaggaggtggaggttgcagtgagcacctgtacactgcactgcagcctgagggacagagcgagattctgtctctccaaaaaaaaaaaaaaaaaaaaaaaaaagaaagaagaggcatttgaacatttgaatggataaagaagaatgaaaattatctctatttacaaatgctctgataacatacctgaaaactccagggaatcaaagttaaaacaaatttaaacaataagataattcaatgatataacaggatgcaaaattaatgttaaaaaatatcattaggctgagtgcagtggtttgcgtctgtaattctagccctttgggagatgaaagtgggtggacagcttgagcccaggaattcaagaccagcctgggctacaaaaaagaaaaaggaaaggaaaaagaaaaagaaaaaaatgctgggtgtggtggcacacacctgtggtcccagctgtttgggaggctgaggtaaaaggattgcttgagcccaggctgggggatgaggttgcagtgagctgtgattgcaccactgtactccagcctgggcaacagagcaaggccctgtctcaaaaaaaaaataataataatagtaattagacaatatacacaaataataaacagagggcataatgatagtgaaaaactcatttactatagtaataaagaagatagttcaaaatacagttaacaagaaatatgcaaagcctatatgaggaaaaaatttaaacactccagaaagaaatgaagacatgaataaatggaaagacattccctgttcttggataggatgactcaacattataatgatgtcagttcttcctaagttaatatgtaaattcaatgtagttccaatgaaaatatatatgttgtggcatataaaagttgatactaaagctcatatgggaaaacagacatgcaagaatagctaggaaaagactgacaaaggaaaactacagaggaggggaactagctttaccagatgttaaaacatactataaagcctctgtaattaaaacagtgaagtactgatgcatgaatagacaagtagaccagtggaacagagtaagaagattagaattagacccacctacatatagcaatttaatatatgacaaagatagtatctggaatcagtgagataaaagctaacttcttaataaatggtgctgagacaactgggtagccatttggaaaaaagggaaaattggacacatatctcacaacaaacagtaataaacaccatatggattaatagtctaaatgtaaaaaataaaatcatgcaacaacaagaaggaaacctgaatgaatcctctgtaatcttggtgtagggaaaggctttttcttaatattactcagaatccaggggcagtagaagataaactgatacattttactacagaaaaataaattttgcataaccaaaacactataaacaaagtcaaaagacaactgacaaacttggagaaaatatttgtaacatacaacaaaaggctaatatccctaatatataaagaacttttaaaccttgagtgacaaagtctgggtgtggttgttcacactggtaatcatagcattttggaaagctgaggtgggagaatcacttgagctcaggagtttgagtccagcctgggcaacatagtgagaccctgtctctacaaaaagtcaaaaaattagccaggtgtggtggtgcatgcctatggtcccagctacgtaggaggctgaggcaggaggattgtttgagcccaggaggtcgaggctgcagtgagctgtattcatgccactgcactctagcctggcaaaagggaaaatgtgaaaaagagatgaacagtcaattttcaaaaaaagatataaaaatggctatcaaatataacttattagagaaattcaaattaaaactacatggagataccatttctcacctatcagattggcaaaattaaaaaaaaaaatcacattctgttggcgcaactgtgaggtaatgtgccctcttatacattggtggtaggaatgcaaattgctacaacccttttgaagggatatttggcaatatctaacaaaattacatatgtacttagctttcaacctagcaatcccacttctaggaatctaccctgaagctacacctccaacaatatgaaaatacatatcagaaggttattcattgcagtattgtttataattgcaaaatatataggagaatgattcactaagttatggtgcattcacatagtggaacactatgtactatgcagctgtacaaaaagaatgaaaaagatctctacaaactgatatggagtgattcccaggacatactgttatgtgaaaacataaaccccccaaaactatatgtagtatgctgtccctcctgtaagaaggaatggaggaataagaaaatacctctgtttatttgtggaaagaaaatgcaggaaggataaaccagaaactaaagagattggtcacctacagggggcacgtaggagaggggtggaagaaagtggggaatgggaacaggatagcaggggtcaggaggaagtgacactaacaaatgaatgtattattgttacaaatgaacctaatattgttacaaatgaataaaataactacatagaagggggtggggaagaaaagaacaaacctaagtagctgtggaaaagagtatattgactggattctataaggctaatgacagaaaggactgtacataaatgctgcaatctagttagaaatatgtttctcaaaggcgaatggcttagcaataaccttatgtacatactagaatgaacaaatgagtacatagattgcagataaggaaagctggatttctcactgttggagaaagaaattataaacaagggaaggttaaaacgaaccagaggtatcgttataaactgaggatttttaatatagataaatggatacagaaatataggcatgtgtatatgggtgggatagtacacatacataaacatctcctagttctgtccattgagcgagcacagcacagatgcagttactcctcagtaataatgagcatacctggtgcccagatcttcatctgtaaacattttcttttcttttcttttctttttttttttttttttttgagatggactcttgttctgtcacccaggctggagtgcagtggcgtgatcttggctcactgcaacctctgcctcctgggttcgagcaattctcctgcttcagcctcccaagtagctgggactacaggtacgtgccaccacgcccagataatttttgtatttttagtagagatggggtttcaccatgttggccaggctggtcttgaactcctgacctcaaatgatctgcccactttggcctcccaaagtgctgagattgcacgtgtgagccaccgtgcccggcctctcgttttttttgagacagggtctggctctgttgcccaggctagagtacagtggtgcgatctcggcttactccaacttccgcctcctgggctcaagccagcctcccacttcagccttccaagtagccggtaccataggtgtgcactaccacgcctggctaatttttgtatttcttgtagagactggatttcaccatgttgctctggctggtctcggactcctgggcttcagcagtccacccatcttggcctcccaaaatgctgggattacaggtgtgagccattgtgcctggccaacatagttctctaatgaaaggaaccagctctgctaaaagtggttgattacaggactgggtcagggcaaattcaggataagcctggaagtctagtggtgccagacaagacatgttgaaataatgcaagagccaacctgaaggaacacctactggctaaagctgaagcaatttgagtaagaaaataatgatagtattggattagaacccatagattaaaatctttacaaatccttattgatataaagatatatttatttcattaactaaccagaggggaagagaaagctcttccttccaatggaattccaattaataaatctgagagaaaagaaaaaaaaatagagaattactggccatgctcagtggttcatgcctataatcccagcactttgggaggctgaggcaggtggatggcttgagcccaggagttcgagaccagcctgggcaacatggcaaaaccccatctctacaaaaaatagaaaaattaaccaggtttggaggtgtgcccctatggtcccagctattcgggaggctgaggtgggaggattgattgatcccaggaggttgaggctgcagtgagccgtgatcatgccactgcacttcagcctgggcaacagagtgagactctgtctcaagaaaaaaaaaaaatacaaaacacaaaaatagagaattaccatcaggcagagatcacaatcataaatactgcacggacacaaatgcactgatagatgctaaaattagtaggtgaaagtctgaggagagagagcattgcatagtctcaaagtatctccccaggataccagcttactagagggaaaataataaatttataagaaaactcttcagacaccaagttaactgagtgattggggtaaatatcaccagtaataagatgtatggtatcataaattctttgatattatccattgagaaggatccaccatattttttgtggaattgccaaaaatgcataacttcattccaatcataaaacactggagaaacccaaagggaaggacgttctactaaataattgatcaggattcttcataagtgtcaaggtaatgaaaaagaaaagactgagaaactcttatagactagaggagaccaaagagaaataacaactaaatgtgaggtgggatcttggatgaaatcctacatagaaaaagcatattaataggagaattggtaaaatttaaataacatctacattttaattaacaatatttaattaacgttagtttcctgtttaagataacttataatatgtgagatgcccacattagttgacatagtgaggaatataagggaactctgtactatttttgcaacttttttgtaagtcttacattagttcaaaacagagtttttaaaagagctgtatacgatcatctcaataggtacaaagaaagcttttgataaaattcaacacctgttcattaggaatagaataaaattttccttaacttcataaagagtgtctttagaaaacccagaacaattatcatcctaattggaaaaatattagaagcattccttttaaaattcaggaatatgactaggatactactattactacttttcttcaacaccatattagagttattaaccagtgcaataaacatggaaaaatagatatgtaaagattggaaaggtagaaataaaactgccattattatagatggtttacataccttttccctctgaaaactacaaacaaattattagaaataatgtgaaaatttagcaaagtagctggatataagattaacatacaaaagtcaatcacatttctagagtagagcgactaacaataacaaaggaagctgccattgacaacaatattattttgtactaatagtaataaatgtagcaaagtatgtgcaagacctaaaaaaggaaaaatttttaaatgaagaaaaactaacaaagaatgaaataaacatatactttattcattaattggaagatttaacattgtgaagatttcagttcttttcaagttgatttgtaaattcagcgcatgttcaataaaaatcctcgtaagatttcaagggcgcagtggctcatgcctgtaatgccagcactttgggaggccaaggtaggaggatctcttgaggcaatgagttaaagaccaataagattttcatgtaatttgataagattgtatgatatttatgtagaagagtaagtggttgaaaacagcagggcattttaagaagaaaagcagggaagaataatttaccctatcagctatcaagacttagtatgaacctatagtaactgagatggtgtggttttgcccagttgaagtcagttaaattttaattttgagatttctgtaaaagatacaagtttagtcttttattatgtatatttgaaggtgttacattttggaaagtgtgtgtgtatgaatgatagctaaatggcttctaagtaaaattcagcatatcttgtagatgttgatagaatagaaggggaaggaatgttttgaaataatgaaaataacatggtatgcaaatgctttgcaagagatttgggaaatgtagatatctctggttttaaggatgatctagattcaagtaatagttcagtaatttcataaaactcttatgacaaaattctggatggagaatattctatgaatcccctagagagtttcaggtttttgtagaatgatgtgaaaaatcttgaactaattagataatctttagaagttacttcacaatctttgtttttacacatacacaggaatttatggtgctttattttttacaggttagtagctaaataaagtatattctaaagtttttttattgatgtagggaaatggctaccagtggacattttgagaatattgcagttgtttttcttctgaaagagtaaaccgggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcacgagctagcgagcgagaggcagccgcgcccgccgccgcccctgctctgtatgccgctctctcccggcgcggccgccgccgatcacagcagcaggagccgccgccgccgcggttgatgtggttgggccggggctgaggaggccgccaagatgccgcagtcaaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatctttaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttggaaataagaaagacctgcatatggaaagggtgatcagttatgaagaagggaaagctttggcagaatcttggaatgcagcttttttggaatcttctgctaaagaaaatcagactgctgttgatgtttttcgaaggatgattttggaggcagaaaaaatggacggggcagcttcacaaggcaagtcttcatgctcggtgatgtgattctgctgcaaagcccgaggacactgggaatatattctagctgaagaagcaaactgcccgttctccttggagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttattggcattaatttttcagtgtagtttgttgtttaaaataatgtaatcatcaaaatgatgcatattgttacactactattaactaggcttcaatatatcagtgtttatttcattgtgttaaatgtatacttgcaaataaaatagctgcaaacctcaaaaaaacaaaaaaacaaaacaaaaaaaaagagtaaaccaatttggttactcattttaccaatttggttttgattttgcaagtggttacaactcatgagaggattcttatttctgatcaatatattgtgtttttggaaaggacttctgggaaataattatgatgaagccctcgagcaattgcaacaaaaccaaaaattgaaaagtgggacctaataatacttttttaaaatttattttttagagacaggatctcactgttacccaggctggagtgcagtggtctgatcatagctcactgcagcctcaatctcccaggctcaagagattcttctacctcagcctcctgaatagctgggactacaggtgcatgcccccatgcccagctaatttttgtattttttgtagagaccaggttgtgtcatgttgcccaagctggccttgaattcctgagctcaagcgatcctcttgtcttagcctcccaaagtgctggaattacatgtgtgagccaccactcccagccccagaacaactattattaaaaagtcaaaaaacgacagatgttggtaggctgtgtagaaaaggaaatgcttgtacactgttggtgggaatgtaaattagttcagccgctgttgaaaacagtttggggttttctcaaagaagttaaaactgaactatgatttgacccagcaattccattactaggtatatatccaaaagaaaacaaattgttctaccaaaaagacataagcacttgaatattcattgtagcactattcacagtagcaaagtcatgcaatcaacctaggtggccatcagtggaggattgaataaagaaaatgtggtacatatacaccatggaattctacgcagccataaaaaggaatgaaatcaggatggtgcggtggctcatgcctgtaattcccacactttgacaggctgaggcaggcagattgcttgagtccaggagtttgagaccagcctgggcaaggtggcaaaaccctgtctctacaaaaaatacaaaaaaattagctaggtgtggtggtgcacacctgtggccccagctatttgggaggctgaagtgggaggatcacctgagcccaggaggtggagtttacagtgagctgagattgtgccactgcattccagcctgggcaacagagtgacaccttgtctcaaaaaaataaataaataaataaataaattgcagcaacacagatgcagttggaagcaattatcctaagtgaattgagggaggaacaggaaaccaaataacgtgtattctcacttataagtgggagctaaacactggctactcatggacatagaggtggcaacaatacacactggggactactagagggagagggttgaaaaactacctgttgggtactgtgctcagtacctgggtgacaggatcacttgtaccccaaagttcagtatcacgcagtattcccaggtaacagacctgcacatgtacacccgaatctaaagtaaaagttgaaaagaaaagacttctgtactttcatctttatagtgaggtgttacatgttttacaaacctagttctgataatgtgacaggaatataaatttatcttgaatattattaaatatataagtcaaagatcaacacagtgtttccatgaggtagactttttttggaatctaaataaccatgtgtttccacgtaaatttttatgaatcagggacaaatatataatttgatgtcagagatgtttttgttccccaaaagctctatcttgttcatgaaaaacgaagcccagagaagttatgtacaagttcacagagctcattattgacaaaaccagaatttgaatacaactcttctgattccagatttgctggaaatactgtgaaagaagaattcagtctggtagtattacgtgtggttttaattttttctttgtaactttagtttgaattttatgtgtgtgtgagcatctgcatttacttttaaaaacttttattgtaaaagccttcaaacatatacaaaagtagagaatacaaagcataatgaacttaagtacctattagccagcttattaaaacatggtcagtcttgtttcacctgttacatcccttttcttttactgtctaaaggaaggaaagaagaatcacaaatcagtttatgaagtctgctttctaaaaagtacttaagtgtttattgccaatatcttattttggtcggcaatcaatcacatactcaagcatacttctcttaccttcagagaaattaaaatttaatcagcaaaactcatcagcctgtacatttaaaatatatgcatgttattgtacagaaactataccttaataaaaagtgagaaaaaaaatgagacaggaaagagaaaaacatttaaaagacatagtaactgaagaattaaataaccaatccaacacttgaaaaatattacaatgtagcacatgcttaaaagctctctgagctcagggaaaaaagcagcactgtgaatctatagtggtcatcattctatgtggtattgggtaggacaagaagacagccttgcagctggaaattggtgaggacggaggcctcgtgtggaaagagtaaggcacactcagggagagaaccagtgaggtggctctgagcctgtttcagaaggggcttgaggaagaacggcagaggctaggatagttgggaaagcaggatcaaatcagactccagggattggggaaccaattggctgttacagggtggtggagtcaaaaaagaacagaaattttgtgtttggttaattgatagaaaatgatattattaacaaagtaaagaagtatgggaacagcacaagttttttggggatagtaaataattccatttccattgattaaaaatatcaagtttatttttacatctaaactgattcaagacttagctattgtacatgttttagagaaaacaaaactatattttatatctaatcatactttacaacataaaatacagttctaaaaaatattatttgtcaagaaaaatataatgttgccatcttttgtctgtatgcatgttttttttccttagattccagcgtagttagtgacgttgtacttcaagacttactggcatatgtgtcctcaaaacattcctacctcagagatcttcctccgagacagcctcagagggtgaacagtatagactttgtagaattggagcaccttcaacctgatgtgttagtccacgcagtactaagagttgttgatttcctatactgacaggtaaacattttgactgcctccttaattttagattatgaaaaaattaagatacaagaccatcttagtgtaccatttggttatcactatatatgtatcatcagctattaaagtatggtatcatgtgtgatagagtaatgccaactaagatactcattttccttttccagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggtaaatacaccaaaaagcatttaacctatttatatttcggtaaatgattaatgtttatgagcccaagatggagaaaatcttaagagacgagacagcatttgaaatacaagtgatcatgattgaatattcttctgcaaatttcttctgttaaaattttgtacctcttgtagcaattcatttatctaataagtcttcattaattaatggtggtgaaataaaggcttaaatttattcccagatatactactttacctttttagtgaagatcttacctccttcaaataatgttctttaaacatttaattctggagaagcttctacaattttttttcagccagagtactctgataaataaatgctatgattataaggcagatgtcaagggagttaccttaactctttcaagtcacaattaatgttcaataaattacagtttcatatttttattatagttgttttaaaagcatgcactgttagccatccctagaatgttcagtgttaaaatatgacccatgattacatttttctttaaagcataaattatttctggtatattgaattaaatggaattgatgtttcattaaaatagtatagtgtcttccctttgctattgtgagatcctttagttgtaacaatcaaagacagtttcatttgtggcttatgagttatttttccctgctaaattaatttagagattgattcagtatattattattttttacctgaaagagttaatgtctctccaaacttctgccttccaaatagttatttgtagataggatctatcacattgtctctcttaatcattaatagctatgactaggatttgagataagtctaactttggacttttatgttaagatcaaacagggacagatgtttgtttggttgagcaagctgacaaacatgtatcagtgatagactaactatgatcattgaccaccatagcctggctgagaacatgagtctagtgcatgctacacaagaatgtaggtcacaggtatagtggagctgtaacagagcagattgctccatgtttaatgtgaatattcttttaaaattaatagttttttggttaatagaagagaaattacagttgtctctaggtgactctatggtgtttaggttagtattgaaaacgtatgaatccaggaattaagatgttgttgttctttgtacattcattcatccagccccccttatttgtaaccatcattttaaagttttaacatctacttcaatacctcacatcagtctttttaagataaaaataccaattttgaaggattacttaagtaattctattttcctgattttacttttcttttcaagagaccaaccccatttccaaattcccagcaaagagaatctgattgcccagagtaaatttgattcaaaaaactgtgatcaggaagacagggtcacgcaatacaaatatgagagcttgagcttatttcagtggatgggaaaacagttaagggaatcatttgtgatctgggtgaatacataaagatattcactaccaaaaatgtgtatgttcattagcttagaaagatatatgtaatgtattatttagtttaaaaagtagattataggccaggtgtggtggctcactcctgttaacccagtaccttgggaggctgaggtgggtggattgcttgagcccaggagtccaagttctcatcttaaaaaaaaataaaaaataaaaaaaattggattgtaaaacttcatgtatagaaaatatattatgttatcatataataaatatttttatgtttatataagttaatacacaaaaattttcaagaaaaccctttatatatgatagtatctcattttaataaaaatgtatctataagtacatatgtgcatttgaaaacctggaaatatgcatgtatagcaaaatgctagccgtagttatttctgtatagtagtattatatgtgctttaatttttttctttatacctttagtttgaatttcatatgtgtgtgagcatctgcatttacttttaaaaacttttattataaaagccttcaagcatatacaaaagtagagagaatactaagcataaggcactttttttttttgtttgtttgagacagagtttcattcttgtcacccaggctggaatgtagtggcatgatctctgctcactgcaacctccacctcctgggttcaagttattctcctgcctcagcctcccaagtaactggaattacaggcatgtgccatcatgcccagcttatttttgtatttttagtagagacgaggtttcaccatgttggccaggctggtctcaaactcctgatctcaggtgattcacccgcctcagcctcccaaagtgctgggattataggcatgagccagccaccgcacccggccagcataatgaacttcggtacctattagccagcttattaaaacatggtcagtcttgtttcacctgttacctccctcatctttactgtttaaatatttcacaataaatgtattttattttataattaaaaataaaattaaaaccttatgctttttaaaataaaagaatagttaatgtttggaaaatctagctaacaatgtgagaaaaaatagaattaaatttatactttatatttgtgccaatataaatttcagatacattagagattcaaatacaaaaataatgaaacaatgaatagtagaagaaaatataggcaaaattatttgtaatgcaaaggttggtagggtaaataaaatccaggaacaaaaactattatacataaaaaccaccatgtacaaaattgaaaggcaacaaaaaaaaaacagaaaaaaaattacattgtcagacaataatgcagtaagcaaaagacacatatctatagagttaaatggggaaaggatatgagtaggcaagtccccaaagaagaaataaaaatggccaataaatatatggaaaaattgttcttacaagtaattgaaaacacacaaagtaatgatgatagattatttttcttttaagaaattgattgagaagatatgggaaaacagctactgtcatcagctattggaaatgcaaactggcagaacctttcttgaggataactgacaattaatatgaacaaattgggggtacttttagcccaataattttagctctaggaacttatcataactatgtataaagatgtagctgaaaatgggtttatcatggtatcatgtataattgtgaaaaataaaaaacaaccagagtccctcaaaatagaggtttgctgtaataatttttaagattttggtgtatctggacaatggcatattatgtaatatttaaaagcaatgtagaataatacatacatataaaactatatttgacttattaagtcaatcccaataaataaaatcccaaacaactggttgtccgctaaaatgttaactgcttatttagggtgttgagattatggctgctatatgtttatttacttggcttctcttagcttacttttctaatcaggtattttgtaataagacaagaaagctattttagtgattggttttaagcagtaacttggaatatatgctttagttctagctagtgatgttctgtctttacagatttactgagatgtttgatgattttccaccaaaaaaaaaaaaaaaatctttagtgaaagaaactaaggagatgagcaggtgtagtaaattagatttatggcctgaagtgagaaactaaaaagacagctgatgttatcagaaaaatgagtgctaagaaaccctcttttgttttattatagttttgaagttgaatttactaatacagaatatgataatacagataagttgaatttactaatagagaatataacagtaacaaggtctgtgttactgtggctttaagtattagaattgtggccggcgcggtggctcccgcctgtaatcccagcactttgggaagccgaggcgggcggatcacgaggtcaggagatggagaccatcctggctaacacagtgaaaccccgtctctactaaaaatgcaaaaaaaattagccgggcgtggtggcaggcgcctgtagtcccagctactccggaggctgaggcaggagaatggcttgaacccgggacgtggagcttgcagtgagccgagattgcgccactgtgctccagcctgggcaacagagcgagactccgtctcaaaaaaaaaaaaaaattgttactgagagttaaaaataagtactattgtgtctaaatgctttttgttctagaaaagttaactaagataactaaagtattgaaatatgagtgaaatattagacttgggttcatttcagtgtcctttctttaacaaaacaaaacaaaactttgcctatagatagatacatgagaattttctttacagaaagcagttggttattataaatgatgaccgttcaggagggcaaggaatctttagaaaatattttattaaaattatctctggtggcccggcgcggaggcttatgcctgtaatcccagcactgtgggaggccgaggtgggcggatcatgaggtcaggagttcaagaccagcctgaccaacatggcgaaaccctgtctctactaaaaatacaaaaattagccgggagtggtggcacgcacctgtaatcccagctactcaggaggccgaggcaggagaatcacttgaacctgggaggtggaggtttcagtgagccgagatcacaccactgctctccagcctgggcaacagagcgagactctgtcttggaaaaaaaaaataataataataatctctagcatgcttctgttgtcttaatgcaccattcatattttgtctctgtttacccaaattctttagtgataaaagattagtattcaactgacttaatcagatcaatctatttaatctgatactaagcctagatttttttttcctttttggtgacttttgtttttactgtttttgtttaaggttatatttgggaatttaaatatctttttgttcagcgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggtaagatttttatatacataaattctgctatttttatttcttttgaaacagagtcttgctctgttgctcaggctggaatacagtggtgtgaacacagctcactgcagtctccacctcccaggtttaagtgattctccccgctcagcctttcgggtagctgaggagggaagggaaggctagtgcataccatcagtgcatgccaccacacccagctatttatttatttattattttggcagagacagagtctccctatgttgcccagtctggtctcaaactcctggactcaagtgatcctcttgccttggactcccaaagtgctggaattacaggcatgagccaccacacccagcccactgctagttttaatataagcaaaaaggctaccacttgtggtaaaaatgtataagtctatataaaagtgaaatataaatctttgcaaatatctgaactagattccagtagttttaggaactatgtgctaggaaccagggacaaagagcaaatacctattttttattatatgacaagtgggagcagaaattcagatccttactttatcttggccaaatgccagattaaaatgttactagttgggttaattcacatatatgtgtaaatatgttttccaatatatgattgaaggttagcattgttatatcataaaactatgctaaggagaatacaggcagaaaacaaagacaatacctctcaaaaaacccaacttttaattgaatacagagatttcattctcagagaagaactccttattcttagttctacactgaaacatttactaataccagcagatagtttaaattaataatatttctggaaggtaaacacagatgatagaaaatttataagcttttatactataaaaatttcatactattttcaaaaatggaagttgcctatggtcataaaagactctagatttatactaactggtaaaatcttggtaatgttatagcatcatgtaagttcctaagccagttttatatttatgtgcccctcccgtgctctgcttctccaacttcacagacatatagaggtggtcaccacaggaaggaatgccagacacagttgaggggctaccttactttgcagagacgtttagtttggtgccatggagaagtcaactctgttatttactgcttacacaaaacagttatctgctgggattgaagtctagaattaggtttaaaaataaaaataaataacatcatggacaacaacaaaataggaggccaccacgctgatgatgaaagattctcaggctatagccccacttgtttgaggacgcagccaggaattgtgcatgttcttggaagtcctggaggtgtgctcctcattagcaagccatgccaaaactgtgccattaaaatcagtccttcagaggctttgttcacagaggcctgtttagcctttttcattctctttatgttcagctatgagggctgaattcatagtttctgtcatagtgtatgtgtttttaagacaaaaatggagagagaatatgaaaacacaagcaacttttccctaacctattttatagttaaataaaaggagaaagagagatcagcatgggagcatttcctagaagggtctgcttgctcaacaaaagccagagggggatgaggctaggcctgagtccttgtaaagaaatgaagacgcttacccagtacctcatcttaccgccagcagaatttcagtgctcagccggagtgacccccttgaaagcaaagtccacattcagcgtgaccttttaattcttttcaagagttgtgtaaatttacaaaatgataggattatgtgaacattcttttaaaattattgaattattacgaattttttaggctgggcagggtggctcatgcctataattccagcactttgggaggccgaggtgggtggatcatttgaggtcaggagtttgagaccagcctggccaacgtggtgaaaccctgcctctactaaaaatacaaaacttagccaggcatgatgtcgggtgcctgtagtcccagctacttgggaggctgaggcaggaaaattgcttgaacgcaggaggcagaggttgcagtgagccgagattgcaccactgcagtgcagactgggtgacagagcaatactctgtctcaaaaaaaaaaaaaaaaaaaagactttttgagtggagggaggagagcaagggttgaaaaactaactgttgggtactctgcctactacaggagactacttgggtgatgatatgcccatgtaacaaacctgcacatctaccctctgaatctaaaataaaaatcgaaattttttttttacatatttttttaggccagacacattggctcaagcctgtaatcccagcattctgggaggccaagaagagtggatcacttgagcccaggagttggagaccagcctggtcaacatggcaaatccccatctccacaaaaaaatacaaaaattagccaggtgtggtggtgtgtgcctgtagtcccagctactcaggaagctgaggtgggaggatcacttgtgcccagggaggttgagactgcagtgagtcaagattgcaccactgcactctagcctggacgacagagtgagactgtctcaaaacaacaaaaaataataattttgtagtgatttaacatgtctttggaaagatgtggtattgaatcttctacagtttgttacatattcgatcgctacgcactcctgctaactcatgtagggatatgtgacacaattggaagagatgatgaaaccgtctttgggcattgaaagactaaagcaaatgaagttaagaacagaagactcatcattaactggactctgaaagagataaccagaaaacagtaggagactagagtgattagttcttgacctggagtgttcttacttctaagtggatgaagaagaacaaatttgaaggcttaaggcttaaagaagcctttaaattgactatggagaaagggagaataatgctcaagaaaactcatagacctcaccagtacacagtaagacaaaagtaaattaggaaaaaataatgtctgggagatagtagactttcagtatttgtttactggtgaatggatgagccattagcagtgaattatgaatatgcttgaggtttcttgtgagtcacctgagaaacgattaataaatgagaactttttataacccacagccagagtatatagatgataatggtgagcggaaagttggaaaaaagtttaaaagagaacaggctattgatatttttacgtagagagaagaagaaaagttcacctcctatttggcttttttttttttttttttttgagacggagtctcgctctttcgcccaggccggtgtgcagtggtgtgatcttggctcactataagctctgcctcctgggttcaagccattctcctgcctcagcctcccgagtagctgagactacaggcgccagccaccgcgcccggctaattttttgtatttttagtagagacagggtttcaccatgttagccaggatggtctcgatctcctgacctcgtgatctgcccgcgtcggcctcccaaagtgctgggattacaggtgtgagccactgtgcccggcccctatctggcttttcaccatgatcagtttaaaagaagacagggcaaggagagagggcatgttagctagtttcaagtattcgaagggatttcttctaaaggaggtattgaacttattttgcctgattccagaggatggggaaggaaggaaacatcacatgttcagccaaattagccaagtaaacctgctctcagttgcagccagacctccctgcccttagattctaggaaaatagtaaagaagacgaagaacaagacctcagtgtatccttttactacaagtgactgtaaatcaactataaaattagccatgtttgtaaattaaagttataattttggcccaataatttataacatatctgtttgttgtttgtaggagtggttctaattaaagcccagatttcagagctggcatttcctcttacagcagctcagaagatagctctaaatgctcacagttctctgaagagtattttttcttctcttcccaacatcatatatactggctgtgcaaaatgtggattggaactagaaacagatgagaacaggatctacaaacaatgttttagctgcttgccatttactatgaagaaaatatattataggtaaggcaactaagcaagccaatttgatggaaaataattattatagatctggaaaaactagtctgtaaactcttactttctaaaaagaattaactagagctagtcgaagagaacaaaattttccctgagtgatagatagctatttatggtagcaaaaattacccaggaatcgttataggaatttcttaaagataggaatttcttaaagcagtaattgggagattttattgtcttcaaacagctgtaccaaagaaacattttccttggtttactttttaaccaaaatctaaatgctcataaataactcattttcccaccttaacatataattagaatttaaaggctaaaagtaccatatgatgtcacctctgagttgttgtggaagctagtaagacatttaagctgttttcccacctttaccttagaaattaaagctagcaaataaatgttatatggtaaaactgctaatcagctcagtgaaaaacacattgttttttgaataataggtagtcaaaagctcagacatttttctctttaccttataaattacatgtgtttacaaaatagcactcagtgttttatgctccttatgattatttctaaatattgcggtatctaaaaactaaattcagatatattccacatgttatcatggcatacttcaagaaaagttatagaagcttaatttgtaaaccttatttctctttacagatattatgtttgttataaataagtgaatgaattttgctattactgtgaaagttgcttttgtggaaaagaagattgaattaagatgtatggtaggctgggtgtggtggctcatgcctgtaatcccagcactttgggaggctgtggtggggggatcgctggagcccaggggttcaagaccagcctgggaaacacagggaaaccccatctctaccaaaaaaaaaaaaaaaaagctgggcatggtgacataggcctgtagtcccagctacttgggaggctgaggcgggaggattgtttgagcccaggagatcgattgttacagtgagctatgtttgcaccactgcactctagcttgtgcaacagagtgagaccctgtctcaaaatcaaaacaaaaaatgcatggtatgtaacaaacaacattgatttattaatagttaaggcccctcaaaagtatgtataggtgacttatttatatcattccaaatgtttctattcaacataagcatttattggacaaaaatgttgctcaatactattccttatggggaggagggcctttgaatctttagtttacaaaatgactgttcaagagaaggacttcacagatcagtatcacctgattatggcataactagtatggggtatttaagatctcttcctaaactataccacattaaagatgtagtgctagtttgttgtcttactagaatgttgaatggtcatgttaaggcaagaattattattttttatttatttaaaagcctttttttttatttttttgagacagagtttcgctcttgttgcccaggctggagtgcactggtgcgatctcagctcatcgcaacctctgcctcccaggttcaagtgattcttctgtctcagcctcccaagtagctgggattacaggcatgtgccaccacgcctggctaattttgtatttttatagagacagggtttctccatgttggtcaggctggtctcgaactcctgacctcaggtgatccacccgtctcagcctcccaaagtgctggaattacaggtgtgagccaccaagcccagcctaaaagcctttaaattattagagtccagattatgtggtttccttggaaagaaaatattgaaattaacaaactcccttcaagttatcaagtatgtgactccaaaatcatctacataaatcaatcagcaaactgaataagagaaaactctcattgattatttttctaagactcagtcaaatatttattaggaatccacgtatgttcacatatcacatgtgtactgtggatgttatactagttgatctaagtagacttattgtgcccaagaagcttggtagtccatttaagaaacacttaatgaacatttgtgtggcacaacagtcccaaactatgagtgggttgatcatattttacattggttgtaacttggagctgattttccaatggaagcaacattagatattgcaatggagtctcatacgaggccacagacatttattaaattaacatgtagatagcatagttcctgctcttcaagctatcataaaactcaaataccatttttaacaatgtttctacagaatattcagatttacatttttggaatacaagaaatacatttatttttctgtactggaagcaaaaaaccccagcaggtcaaaccacaattaaggctcctatttaggcagcactaggaaatgtttgggtctctcaagaggttgtagtcaaggtgtaggctggggctgcagtcatctgaaggcttgactggggctggaggattcatttccaaagtggctcattcatatggctggcaagttgagttcctcttcacttgggtgtctccacgggctgcctgaatgttctcacaaagtggcagctcatttcctcagagcaggaaaggcaagaaagagagttccaggtggaagccagcctttttgtgacctagactcagaagtcatgtggcatcacttctaccaaattctgttcatcagaagtgagtttagctgtgcgttggagagtggattagaatgaagctagtgcagagaagcggtaagaggctgttgccttattttggagaggagatgatggtggcttgactagagaggaagcggtaggaataaaaagaagtggacagatttgagaatggtcagaaaatagtttgcaagatgtagtgattggtaggtaaagagagagcacaggtacattgcaaatcattgacagttgggtgaacaataagattatttattaaaacaagtaaccttgggagaaatcttgatcatattgagcttgagttcctgagaggtaacaagttggaaagtggttagatgtaaagaaatgcaatttgcaagagaagtctgggctaggcttataaggttatctgtggtgattgaacttttccttggtttctgcaccctgttttgtttttccttcttaatcttcagtgattacctctcataatggattattcttactagcctataaagacagtcccatatttctcttattaaaaaacaaacaaaatcatccattaacattacatctccctcttatcccttcgtttttctattctgttttatacccagccaaactttgttaaagagttgtaaatatactctctctcccctattatgtcttcagtttcacttcagttattccattctactcctaccatgctgcagaagctgcttttgtcaaagttacacttttgatgttgcctgaggcatggatacttctttcctcgctctaactgctctcagttatattcagcatgtcagtccacttcctccttcttgaaacagcctcctccttgctttctaacctgtctctcaggcccttctttctcagccttttctaccccctctttaaatgctctcgtctgtgtccttcctcttattctttctgtacattctgcctggatgatcacagctgttttcgtatttgtacttaacatcttcaccctgattttctcctccaggctccagtagtcaggtatcaaattctttgcttgatgtccatctcacatttaaacatacccacaatagactcttgtttttcctaaaaccacactcaaatctagttctcttcgtttttatactttctggaaaatggcacaccatctacccaattatttaggctggaaacctgggcacaatcgttgcatcattttctcttccctacctcccctatctaatctattagcaagtcctaggaattttcattcagaactatatcacaaattcatccacttttttccatctccactgctaacatcttagtccagtgtatcccagcaggggcattgttgacatttttctcaggacagtttctcattatgtaccatatcccacatgctgcggggcatgtggcatccctgtttaccttcccctagctgaacctcaattactgtgaaaccaaaatggaaagtcagtgcctgctggtctggaatcactcaggcctcatctgagtccctactacctgttgcgcaaaccagcacaccagcagtctcttggtggggctcctcctggccttgcctcctcccctttattctccacccgttggcagtgtgattaccctttgcttcacccatcagtcatctccttatgcttgtttcctctgcagtctcatctgctgccactcccctgttgtccagcactctagccacgtggccttctttcagttcttcagacattttgatttttctccttaggatgttctcgaatgtcttccctctgactccacaaggctggtttcttcatgtcttagattaaatgctgctttatcagagaggcctctcctaaccacccttctttattttctgttatagtagcctgggtgtgcttactgtaatttgtatttgcatactgtcttttctaaaaaacatttttactgaagttaaaattcatataccatcaaattaatcttctgaaatgtacaattcaatggcggtagtatattccaagggctgtgtagctatcaccacaaccagttaggacattttcattacccagccctttacaaagcctcatactcattagcagtcactctccattccccatgcccctcaacccatggcaactacgaatctgctttctgtctctatagatttgcctgttctagatattttatataaatattatataatatgtgatcttttgtgactggcttcacttagcatgatgttttcaaggtccatccatgttgtagcatgtatcactacttcattcctttttattgcaaaataatattttattgtatgcacataccacattttatttatccattcatcagttgatggacaattgggttgtttctactctttggctattatgaatgatgctgctgtgaacatttgtgtacaagtttttgtgtggatatgtgtgttcatttctcttgggtatatatctaggagtggtggaattgctgggtcatatggtaactgtctgtttaaccttttgaggaactaccaggctgttttccaaaattgctgcacaattttacattctcatcagcaatatgagggttgtaatttccccatattcttgccagtacttcttattccgtttttctttttgttgcatgtgctttcgggtcatatctaagaaaggtgtcatttctaagccaaggttatggagatttgctcccgtattttcttctaagagtttagtagttttacctcctacatttaggtttattatctactttgagttaagttttgtatatgggataaggaaggggtataattttattttttggcatgtggatatctagttgtcccagcgtgaatttttgaaaagactgttccatccctgtttagtcatcttggcaccactgttgaaaagcttattttctttcttcttctttttgtagagatgaggtctcgttgtgttgcccaggctggtctcaaactcctggcctcaagcagtcctcctcaccttggcatcccaaagcgctgggattacaggcatgagccaccgcgcatgcccaatttcttcctatccctctacagttttacgttccttgagtgacggaaccagatttgtctttttcactagtgggtacccagcacttaccacagtccatgatagatactcagtttgtatttgttgaaataaataatggagggagagagaggctgaggaaagagtgtagagtgaaaagaggaaggaacatagagtcatcgtgtgaataaagggggaagtgggtttttagggggaaaatcagtagttatgttttagctctgttacattaaattcccccgctaatgagcctgtttctgaattctgttctcaatttattttttaaaaatcaatgtagttataaaataggtaccacatgccatggttaaaatgcacactacataggaggttataaaacaaagagtgaaagtctccttcaccatccaaccctctcccaccagtgctgcttccatgctggtgagaaggttttttgtatgtccttccagtgatttattatgttcatcccagcacatgtgtatccctttctttagaagcatgtggacagaagaatattgttcatattgttgttccctagagtctatcctggtgctccttccctaatagcacttgcaaatgttcttcattctttttatcagctacatagcattaagatgtaggatgcactgaaaattgttaatccagttttattgatatgcaaaacagtttatttctgataggaaagaattcagttgaaaaaagtaacttgaaattgtgattgtgaaatatgtgattattatttttattttcatttctaaaaacaatttataaaacagtttaatatatttttatattagtatctgaaatttaaaaatggatatagaataaataaaatgtagtaatttatcatttgaagctcttggggaaaaaaaaacctttttttccttctaggatgtcacagaacatcctagagttgttttaagcattaaaattaatcctgcattaaaaaccaagtgctttttggaattatttttcatttaaacatttcttttatttgaaaatctttttgaaggtcgtgtgttgtttactcttctgtaggccagcgttaatgactgccgttgatggaagacataatgtttacatccgtgtagaatcaaaactgatagagaagattcttctcaacatttctgcacactgcctcaacagagtgataggcaatatatcagtgtgccatcaagaagttgttttattcaggagtataaatggtatatcggaacagaaagagcactctactttaaattaagagcttttctgtccatatgaaaacagaaggataatttagcttaagtgaaatataagcctatgtaagttagaaggttgacttgctttacacctgttagtacatgaacagtgggaggcacctaatttcttcttaacctacatttcctgttggtaagcaaaaactattttacttaactctagttttataagaatgaagtcaatgagtgtatgacataatatatatgaagatagtccagtgtcagtggaatggatttgcaagatcttcaaccatgatgtcttagttgtcagtggctaagaataaagcaaagataatatatttgtcaggtattcaaactccattcctgttctcattagcctcagatcctctaagctgatgagctaatctggttctgtgattgctttatctttcaatagtagattgtttttcgtgtttttttttagttgggggtgtctagtaattttgggttgaatgctgaacgttgcatatattaagtagaacagtacaaactgaggtaaatagtagttgtacctggaaacaggcatgcctcttctggtcctttactggaggtgaggggtgagcaggatggtcagccttgtcataagttgagttggattcaggttttgttgtttctctggttaccttcaggtcaccactggtttcaaattatcttgtgcttatggtgggaagtggttccccagtattcctgctccaccatcagcatagccctccactctgcacctgggcctcagagaaagtttctttccatattcttgcacctccccaagttgcacaagcttttgttggttgttatttggtgcatcctaacctggtgggtgggagcagggttgttcctctttgattctggtccagccccagtcttatacggatgttgcacatggcgctttcttggtagccctgtcccttatgtggcatggcagctgagctctgtcttgtgcctttagtgggtcttgtgtggtcctggccctgccccagcagtaggggaccactaatggtcttgacccagggtggtttttcagtcctcccccaggatggaggtttttttttttcttttttctttcccccatctgtactggttcctcacctgtaccctggggcaacaggatttggtgtccctcctccagcaattgaaggcttttgttccttaaaggggaggccagatggtgctttgtgttttgtagttggaagctttctctgatgtcttgccctgcccccagtcttatgagcacctggtggaggtgagacgtactatgtggaagagcctatgaggatgcagatgttccttatgttgctgacactggcagttcattggctttttgcaattaatttattaataaaaattaatcacattcttctttcctgcctgtatggaggacctgtcttcttcccaaggcctgccccaagggaacctgtgctcctgttccatctccctggaggcacctgtctccttatgtttcagtctttttggctgttttacaaccttggttctcatgtgtattcaagaaaatgatgattttatatttattcagttttttccagtaactgttagggtaggagccactttttccagctttctacatcttaattagaagcctctctccgttttttcccccattttctttatttcatttttattcttttggctattttcattccttttcttaatgttacttatatattttcagtgttatctcttctttttttttttgagatggagttttgctcttgttgcctagactggagtgctgtggcgcgatctcagttcaccataacctctgcctcctggattcaagcaagtctcctgcctcagtttcccaagtagctgggattacaggcttgtgccaccatgcccggctaattttgtatttttagtagatatggggtttctctatgttagtcaggctggtcttgaactcccaacctcaggtgatctgcctgcctcggtctcccaaagtgctgggattacaggcgtgagctgccgtgtccggcctatctcttcttttttgcataatgtaaattagtctttatctcttagagaagcataattctcatatcacatatacttcagtgttttgtccattcttgagacaattaaagttgtacttcttggcattaattagattgtgatcataagtcaaaatgtcattggtcataaagtggtcatcagaccatgcagactattactaatattggttatgttttagtttattgcagtgaaaatacaaaatttaaaagttattgtagagaattatcataccccccaaaatatgtcattggtcctccaggactctgtagtccccatccaagaaagactgtgataattgtcaaggggttagtacggtctgagcatggtcgatggtgctctgtcattctggtattgaacaacctcccaaatgtcttgattacatgtcctaaaaaagtgaggggaagagtgtaggacaaatgcaaaataaaataacacatttagctatacttttagtattttttattattgagattcaatatttaagtgaccgattcaagattcttttatataaaaaatgaatatatgcataagtaactgtgataagaactgtggatggataagagcactcgtctgatgtactgcagcataaccagaactgctgtcggtctgaacggtgtgttatctgggcctgtttcttgtgtcagggggatcacatgccgtcactctggagtgcctcaatagcttgtaactagaaagagaaggtatagaaagagtagtttacttacctgtttatttatttagaggcagagtcttgctctgttgcccaggctggagtgcagtggcacaatctcagctcattgcaacctctacctcctgggttcaagcaaatctcctgcctcagcttcccgagtagctgggattacaggcatgtgccaccactcccggctaatttttgtatttttagtagagacagggttttactgtgttggccaggcatgtctcgaactcctgacctcaagtaatccagccacctccgtctcccagagtgctgggattacaggtgtgagccaccgctactggccgggaggagaaatttaaaatgggtttgagacttgaggaaccaaaagaaacaatgaaaccattcaatgtgtgtgctcctgtcaagctagcagcgatcttgagagctctgtgttttcgtcttctgcagttccttcctcagagatcacctatgggatggttgtggcagacctgttccactccttgttggcagtcagcgcagaaccttgtgtattgaagattcagagcctttttgtgttagatgaaaacagctatccattacaacaagatttctccctcctggatttttatcctgacatggtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagataaattaaaacttttttctaagaaaatcctgtgaggtttaaaaagattgtttttgtcttttggtttcttcctttcttctggagaaatgatctaccagtcaaggcaatatgtagcagatccctgggaattaaaggtttgcccatttgttcactgtatttagtccctgctacattccaggcatcgtactaagtatggggaaccacagagaagacactccttcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaagtgaaggaaatgagatcatgtttcaatttattaaagcagggaagagcgttctgtggttagttcgtgtctaggatttgagtgccttactgaatgtatttaccagcaaacatgtagcaatctgttctctcattgtgattgtggaagaagctcatgtaaaatgatagtcattaatgaggaagtatggcgtggtacttattctgtaagctcagagtatgctgagtgttaatagattgtcatattgcctgaaaataaattcatgatgacatgaacaagcttcttttaccctgtgtatgtttttaaaaattcctttggttcagaggtggttgttgttttttaacttggcttccctaagaacgaaccacaagagttttgtgattctttcaaaaataatatgccaaaatgcctttgtgggagcacacacacacaaatgcatgtttctgtggagaaggatccatagctttcaacaaatcctcagagggttctgtgaccaagaaaggtaagaacaaggctttaactgatgagtttctttgtggggtagataagggaattagagcaaatgattgccaaagttttgtctagcaactaataaggtgggtacagaaagaattgactccattttgtatctagagagactggaattcaaacaaaatcattggctcccttcaatgattcgttgaatgggtgatgaaacttgagcctgtagttgacgccttctaatctgtgctctctcaactataaccacactaggcagagatttggaattctgatataaaatctgcccagtcaatataggccaaccaagagagctgttcgcttaagtgtgcccttccccacttcgtcctcaagtggagacctaatccctacatcaaccagaacataatccccaggaagagatggctcttcacatcctattgggaagaaatctttaaaccatttcaggtgagtcaacagatcacaccaacatctcttcacagttgttggtatgtatttcattaattaacacatatttccaggagcccttatttaggttgggaactgtttcctccagtcctgaggaatctgagctatctacagaagttatgagctatttaagtgggatcaggatcagcccattgctcctgctatggtctgaatgtgtcctcccaaaattcttacgttgaaacctcatctctgatggcattcagaagtggggcatctgggaggtgattagatcatgagggctctgcccttgtgaatgggatcagtgcccttacgaaagtggcccgagggagcttctttgtccccttctgccacaggatacagccagaaggtgtcatctttgaagcagagagcaagccctcactagattctcaattttctggcaccttgatcatcccagccttcaaactgtaaaaaataagtttctgttacttataaattgcccagtctgttattttgttatagcacccagaacggactaagacaccttctgtgtgtattctttacctgagttgacaagtaagtgtctttattctgttatgttttcataaaactcagtggggtagccagagtgtcatccagcagtcccatatctggcagtcttatggtgggcatttcagggagacctcattcttcatcttctgttagttcagcttgcagggacagctctcctatttttagagaatcatttttatttgttagtcacttagtttccccagaggtatcctttttctaacagcgttagaggcattcacctttctccccactagtaagatctgtgctgtttcattttacatctttttttttttttttggttgggggaaagggggctgatcatcaaatgagttgacaacattgggtgcatgatccaccctgcagacgttcgctgaatgtctaccatgtgctaggcactggaaatgcaaagacacaaatgtctgccttctgtaagttcacaggcaagctggtgaagaaatatttaaacaaaattatatcagcgccaggattaaatctgtgtggaatacagagccaaggcaaaagaggtaacagtaggatgggtttgttagtcatgactcttggttgcaagtgataaaaacccaactcagagtagcttgagcaaaaaagggggacttgattgactcacataaatgagggtagtaccagcttaaggcacagttgaatccattggcctaaattacctggttaccccaactccctaatttttctttctttctttctttctttctttctttctttcttttctttttctttctttttctctctctctctttctttctttctttctttctttctttcttttttctttctctctccctctccctctctctctctctcatcagaagaggtcttttacgctgttattgcaaaagcatagatgtttctacagagttttgataggataacattttcacagtgattatgaatttacatcgtccctagaattctaaactactgggatctgaggccgtaagttgtttaagagtattctgacattaccttagattcagcaaaacttgaatagttgatcatgcctttcttagaagaaaatatctgtaatttctcagaacaatatagaatgagacagaaaaactaaccatccctatgtgccttattttaagtgatatatttgtatcctgatgggtttctaggtgttggaacacaggtcatgaatcatagaacaattagaataaagtgttcgtctttatcagtagcttaattctggcccttgatttaatgtcaacaggggagaaatgtgtgagaggggatgaggtttgccaattaattgtcattatgtctttggaggtcttgaacctgatttgttattaagaagtgaattctacccacttaaggcatacatttgctaaaggtgacctctctgcttccacgttgttaagaaatcgtgatttttttcaaaacaatcatcagctttacagtttttgaggaaagatctagaagcctgttaaaatggacttaccaggcagggttcagcccaggaaacacaagccactctgggtattctaaacagagagagattaatgtggaattcaggtgtttgcaaaggtattggaaggctggaggagcaggcatcagtctgagctccaggaggctgccacgtgaacggtggattcatgaaaacatcatcattggctgcaatcttagactgaggatgcagctgctggcatcccggcaactgactctcaagcacatggaagctgggagttatttgctgctgcccaaaactcagtccccacagctacacttgccaggaacagtagcttcaggaagatagcctggatttcactcatcttccatattgcacatgtgtgtgtgtttcattgatggaacatgattcacgctgagagctttagctgcaagaaagtttgggaaatatgtcttctctgaggcttttggtctttgcagttcaggagcagttaggaggtgggactggttggttgcagagtgagctgatttactgcacttagtctagcttattaaaggatgagcttataaacaccccaggtaatatcacaatacataagtgctacctaattactgtgtgggtctgttaccaagaatgtctaagtcaagaaattgaagattgtttccttcagattctgcatcctaatgtagaatctttcctattagagtataagtaaattattttggtgtgttatttaagaatatttgtgaataggcttaattaaacaccatgttaagaaattataaacttaaggccaggcacagtggctcacgcctataatcccagcactctgggaggctgaggcgggcagatcacttgaggtcaggagtttgagaccagcctggccaacatggtgaaacctcatctctactaaaaatacaaaagttagccaggcgtggtggtgcacacctgtaatcccagctacttgggaggctgaggcaggagaattgcttgaacctgggaggtggagcttgcagtgagctgagatcacgccagttcactctagcctgggtgacagagtgagactctgtttaaaaaaaaaaaaaattataaacttaaaaaaaaaatgttttcctttaaacaaaaacgcatgttccttgttttttgttttgttttgttttgccttttttgagagacagtcttgctctgtcacccaggctggagtacagtggcacaattatggctcactgtagcctctacctcctgggcgcaagcaatccttccacctcagcctccctggtagctgggactataagtgcagaccacaacaactgattttttattttttgtagagacagggtctccctacattgcccaggctggtcttgagctcctgggctcaaccgaccctcttgccttggcctcccaaagtgctaggactataggcgtgagccactgcaccaggccgtttctttttttttaaaactttggaaaatatggatgaatgaaagtgagaaaagtaacccttctgttattctaccaaccaaagctaattgctgccaacattttaatagatattccttcggttgttttatgcatgtatgattttgtacatgtgtctactttaaaatatatagtctttcaatgttgcccaggctggactcaaactcctgggctcaagtgatccatcacctcagcctcctgcatgtatctacatcttattttattttatttttagagacattctgttaaccaggttggagtgtagtggtgtgatcatggctcactgcagcctcagcctccctgggctcaagtgatcctcctgcctcagcctcctatgagtagctgggactacaggcatatgcctccatacctggatactttttgtattttttgtagagacatgtttttgccatgttgcccaggctggtctaaactcctggcctcaagtgatcccctttgcctcagcctcccaaagtgctgggattacaggtgtagactaccacgtctggccaacattctcattgatagtctttgcacacatctttcattccttctgggaatttattctaagaaaatagaattttggggtcaaagtacttgtatgtatgtatctgtaccaggaaaaaagcagaaattccagtatcaacagataacgagagccacgcagggtggtacatgcctgtagtcccagctactcaggaggctgaggcaggaggattgtgtggcatgagcccaggagttagaggctacagtgagctatgattgcaccactgtactccagcctgggcaatagagcaagaccctgtctctgaaaaaacaaaacaaaacagataaccattgttactattttgttgaacattttccagataccctgatagaagacagatctgtgcatgcacatacacaattttacataaatgggaccattccatataggccagtatctagtgtgtactttttttactccacaatttgccatatacgtctttccaaatcaatcaacatagattaaatcatatcaactacacaggattccatcatttgtgtgtgctcttgaatcctacttttaaaatgttctcagaaaggttatcctgaaatatattcctatcagaagttttccacactctctctaaactgaatggcataagtgaaagactagttgttaggtttaaaaaaggttatctgttttaattggaattttttttttgaggttttctttttcttttttctttttctttttttttgagacacagtttcactctgtcaccctggctggagtgcagtggtgcgatcttggctcactgcaacatctgcctcctgggttcaagcgattctcctgcctcagcctcctgagtagctgggattacaggtgtgcaccaccatgcccagctagtttttgtatttttagtagagacaggattttgccatgttggccaggctagtcttgaacttctggcctcaagtgatctgcctgcctcagcctcccaaagtactgagactacaggtgtgaaccactgttcccagccttaattgaattattttattgctaaagtgattgtacatttgcttcatatgcttatcagtcatttgcagtttgctttttcatattttaccttagaccatttttatgtgggagaagccttttattaaattagtatgttctccttataaagttagtaatttttaacatgtgttgcagacatttttcccaagcttgttatatatgtttgacatgcagaaatcataaatatttacgtggatcaacccatcaatctttttctttattgtttctagattttatggcatgcctagatagcttcttttctactataagattatacacattttcttcaaaaaattttttgaaacatttatgattgttatatttgtatttaaatctttaattatctaaaatttagtgcatggtatgaatggatctaactgattcattttcctaaaatggtcagctggttgtcccaacactattgatttctttctttcccatcagtgacatagatgtgatctttattataatatgaaattattattcctgctagcattacctgtggactttctggtctgtttcattgttctatatttattgctgagccagaaccatacagttagaattattataactttacatctgataggaaaagtacccctatatttttcttcattaaaattgtttttctcagacatctttgcccatctgttcttttttattccccattaagagtatatgttgcagtgttttttagtatattcagagtgtgtgaccatcagcacactcaattttggaacatttcatcacccccaaaagaatcatccatagttacattaactataccaccccacagctcttccttaagaggagctaacagtcgctcctccatacccaccccctttcccccaaccctaggtaaccactcttctacttagtggctgtatagatttcactattctgacatttcacatgaatggaatcatacaatatgtggtcctttgtaactgatttctttcacttggtatagtgttttcaaggttcacacatgtagcatgtatcactacttcattgtttttattgccaaataatattccattgtatggatataccgcattttatgtatctattcatcagttgatggccaactgagtttttcccactttttggttatttttaattatactatcatgaacatttgtgtgcaagtctttgtgtggatgtatattttcatttctcttgggtatgtacccaggagtggaattgctgggttgtatggtttaaccatttgaggaactgccaaacttttctaatgcaggtgcactattttacattcccatgagaatgcattggagttctgatttctccacatcctcaccagcactttttattattatctgactttttgattatagccatcctagtgggcatgccatctgttcttgagataagtttagaatcatttttatcccattgatatttttaatgagattgctttgaatttatggatcatttggacatgttttcagtggttaaggcttactatttaagaagagcatgctttttcaattaataaagtattctttaatgttccttagctttagctttatttagcagtccacatttaaagggtattaactatggaaatttttttttttttgatacagggtctcactctgttgcccaggctggagtgcagtggtatgatctcagctcactgcaacctctgcctctcaggctcaagctatcctcccacctcagcctccttggtaactggggctacaggcatgtgccaccacacctggttaatttttgtattttttgtagagatggagttttgccatgttgcccaggctggtctggaactcctgggctcaagcaatccacctgcctcagcctcctaaagagcttggattacaggtatgagccatcagccagtttttttgtttttttaaatcattgatttcaactatgctctgttgaatcccttttccatcccctcatgtctcacatgcctcacataacttcccaggcattgtgttttagaaagtctggtattgtttaaattctaacctcattttgctcttctccagagcatgtccagctagtcactaaagggacttggaatggggaggagataggtgcacccttcctttcctttgactccagctgttggagctggagggagggcgtgaactggcaccgaggtgaattctccccattccttcccagcttcctgaggcctagctcctccatgagctggggagggagaaaagaaggaaaggggacagtggtacttaccaggcagctaccactgtggtcctctcctttgatggactccgcttttctagccagtacttaactgctgatgccttctgtgcagcaggcgttgagtactcctctttctggggtccatgtgagagttctttcagagctcactcttctatgtactctatgtactcactctatcttatgtacacagttgttttcatgggagatgcagctctgtctggtctttcctgccccctccactctctccaactgtacctcctttctccatcttgcaatctctctctgattcacttcactcgtgctcagacaggcatggagagcaggtcagcaaattcttcacactatcagactttagacaagctaaggaatttccttctctgcatactgtatatagcacagtttgatttatgtaacatcctaatcatactgtctggaagaatcttaccaaaatgatattattcccctacatggggaattagggcttgattttaccttctttattataattatttttacttgatcaaattactaggaaatattcctccacttctaaagaatacaatttccctgtgttagaaagatcagttctggtgtggtggctcactcccgtaatccctgtaccttgggagcctgagatgggaggattgcttgaggccaggaattggagaccagcctggacaacatagcaagatcttgtctctataaaacactaaaaaaaaaaaaaaaaaaaaaattagccaggcatggtgacacactactcaggaggctgaggcaggaagatcacttgagcccgggagtttgaggctgcagtgagctatgatctgccactacactccagcctggatgacaaagcgagaccctgtctctaaaaaaataaaaccaacaacaaacatacataaataaaaagatcacatccaaataatagaaaaagatgatatggttttggtccccaaaactgacatcatgtaggagatattggaactttgtgggtgggagccaagcccattctggtgccccttctctaggtcacgtctatactgcttgtttggattccttggcaaaaactgattatgcaaggcagtaggatgcctggctcaaattgggtcaatcagatcctttttcttggaatttaaaaaaaaattgcatgaaaacgtatagttaaatgcacaggtcttaagtgtacaatttagagttttgacaaatatatacattcatgtaactgaaccccaaacaagatatggagcatttccatcaccctagaattttcattcatccccacttccagtcagtctcctccatccatgatggccaaccactattctgatttctatcactatacactagtttgatctttgtttggacttcatgtaaatgaaatcatacagtatatattcctttgtaactggctttttttaacctaagaatgtttttcaggcttatccatatttttatgtgaatcagcagtttattcttttttattgttcagtaatatatcaatgtgtgaatatattatccattcgcctgttgaaggtcatttgagttctttccagtttcgaactattatgaataaagctgctaaaaacatttttaaaacaagtcttgttgtggacataagtttttgttggggcagggatttaaatagctaggactgagattgtcagtttattggataggtatatatttaacttgagaagaatctgccaaacagtgctccaaagttgtgcaattttacactctccgcagccaaaatggaggcttccagttgttgtacatccttgtcaacatttgagatgtcagtcattttcactgtagccattctagaggctgtaaagtggaacctcctggttttggtttctctttcactgatgactaatgatgcacaacttttcatgtgctcattggccatttgtataccttcatttgtgaagtgtctctcaagtcatctgcacatttatcttattgggttgtttgtctttttactgatcagacatatgtattctagataaaagtcagatatatgtattattgatatttcaaagcattttgttcagcagtagaaatgctggctatatgatttgagaataaaaatacgtatgtaatcgtaacaagaagtcttaaataaattaaaatgtcactattttgaataactagaatatatattaagaaaaataatcccaggaaataaaaaatatgctagtaatatattaattacacataacaaatttacaaaattatattaccatataacagtaatacataattctaaataaaaataatcatgctcacagataaaaccaaaaactttaagagcttaatttattgaaaggaaatgatttaaatatcatgagggaaataaaaggagacaagaagtagtggaacactctactgtgctcctgctgtttgggaagatgtactatacagagttaattcaacaataaacaaagtccctgagggatggcctatacaagttgacaagttgatgtaaaaattaattgagggaattaaacagaaatgtaaatattccaataaccatcgaattatacattttaaatggatgaatcgtatatgtgaattatatctcaataaaacgattataaaaaaagaataaacagggattttttttttttttgagacagagttttgctcttgttgcccaggctggagtgcaatggcacgatcttggctcaccgcaacctccacctctcaggttcaagcaattcttctgcctcagcctcccgagtagctgggattacaggcatgcacctccatgcctggctaattttgtatttttaatagagatggggtttttccatgttggccagactggtctcagactcccaggcttaggtgagcctctcgcctcgctctcccaaagtgctgggattacaggcgtgagccactgcgcctggcctaacagggaaatatttttcaagttaaagcaaaaaaacaaggtaagccaagtaaaactatataaaaatatatgattttggtgtttacagcgcattgggtaaaaaatcttactcagaaacagtatgtaaaatatttcatttttagaaaactatacattaaatcaatggagagtggccaaaaaattttaacactgtttatctcaaggagctacaactatggtaaatattttccttaataatgaaatgtggaaacatttctgagaacagaaataagacgaagatgtccattatcatcacttgtattcaatactttcctggtattcctaacaagagtaataaggcaaaaaagttgaaataaaaatactaagattggacctaagatacaaaactatgtatgtatattaacaactcaaaagaatccagagacaagttattagaattagtgagtttagcatgactgaataaatggtcaaaataggaaaaccaattttatttctgtataccagcaagagttagaaaataaaacattttaaaacaataccatttatggtagcataaaaattcaaatgtctggggaaaaatttaatgaaagatgtccatgacactttaaatattatttagagaaatgagagaagaggtaaataaacagaagtacataccatgtgaactgattagatgacccagtattttaaagatgtcaattctcccctgaattgacttataaactcaatgcaaccccgggcgcagtggctcacgcctgtaatcccagcactttgggaggctgaggcgggcagatcacgaggtcaggagatcgagaccatcctggttaacacggtgaaaccctgtctctactaaaaaaaaaaaaaaaaaaaaaaatacaaaaaattagccgggcgtggtggcgggcgcctgtagtcccagctactcgggaggctgaggcaggagaatggcatgaacccgggaggcggagcttgcagtgagccaagatcaggccactgcactccagcctgggcgacagagcaagactctgtctcaaaaaaaaaaaaaaaagaaatggaaaaagaaaaaaatctcaatgcaatcccaatcaaaatcacaacaggcttcatatatatatatatatatatatatatgtgtgtgtgtgtgtgtgtgtgtgtgtgtgtgtgtgtgtgtgtgtgagagagagagagagagagagagaagttgcatggttaggtggtaaaagcagtgtttgccataaaaatcaggtcgttggttattttggtggggagggagaggtagtgtttggaaggggacacaagggaaggttttgggacgcatggtataccggttgtcaatgtatggcctcgcacctccaaatccatcctttaatacctgctctgtgggcacagccagaatccccttccgcggctcccctcgcggcagggaggatgctgaacagtagagggcgctggagacacgctgcgggaggctgtcgctcgggtccggctgcgggccacaggccgcggatcgcgctctgccagcgccccacgcccgcaagcgcggcccctccgccacctcgcggcccggcctgacctgttaatcacgtccccacggctctcctagcggggacaccgccgtctgcaggctccgtccccacagtgcccagaccccgggaagtttgtcagtcagcaccctgatgccagccgattctcaaaaagccaggaggatccaagcagatgatttgccagacggtactgcagcaatggagatgaacagataattcacacagaaagaaggacggtagggagagacgtgcggggggtagggagggcggaaggaaggtctaggggaaggagcggagggggaagggaggaaggaaggcagcaatggaatgaaaggagaagggaggaaggactcgttgaatgcacagcctccccggtgctgcaccgacaggagcggctctcacaggcatggggcccccaacagaccctaccaggctgcgggaatgttgcggccctgcagggcgtctctgtcttttttgaggtgtctctggtaatatgtgataatgacagtatttttagacatttggaatctgatttaaattttagctccatcaccttctagctgtgggaccctgagaaacagcacatcctcccggatcctcccatctctcttgtccacacgtggggaaggctcctggtgggggggggttgggggggaggggggaagggggggttggggggagggggaaggggggggccttgcagatttaccaagctgatgtacaaagacctactacagcggtaagggctagctcctttctcccactctggcagtcactccactttgagaaacatacatcttgaaataaagctacaagtggagaggggcaggtgatttgggcaaatgattccatactaaatgttaggacaaaacatcctaggcaaatatcacaatccggcgtcatagtggcatactaaattcaaccaagaaatatacccatgatgttgaaagagccaggcttatggaatgtaaacagcaaactattttattcttgttttctatttaccaattcaaacttactctgcaggtcactcctccctgcccctgggataaaatctagggcatgttctgtgactttctggatcacaaaattcacatgatttttggatcattctcagttaaccaaaaatgtgtcctgtaacttctagctataaaaataggctctgttcagcatttaaaatgtccaatcccatgtaggagtctaaactttcgatttcattttaagtttaagcttcctcttgattcctcccccaagtctggcccaggcttgcatttggctccaggcattgggcgggtagcagtgtttcctctccatttttcactttcactcttccctccccaactagcttgcagggatttctgatcacctagtagagtctagaggcgtaagggaaggaggtcaccaaggggcaggccaggctttatgtgaatagtgctgttgtgagccaagtacttgagtacttcgaggtccccttctactgcagacatcttccctatggttcctgtgacccaggtttgtctcagagtggggttagcacacggtaccatctccatcccctttaaaagtatttattacatttttctggaaatggaagtctgggaattatatttccctgatagtcttatgagcaggattccaggttgattctgccaaatgtgaggcactcaggtgagactagaaagcagaaagatggtttaaaaaatcatcgttttcttcctttgactctgcacttatgacagcaggatgctcgagactcttgcagtaatttgggcaaagatttccacagtgcaaaatagaaaaaacgtaactggcaaatagctgtacaaattacagtccattttcatcatggaatgtcagtttggcaacaatggcatcgaggcccaaaagcagctctgcagtaggggggttcctccttggtgactggatgggcacagcgaagcacaaattcctgaagatcccagctccaggaaacatcagcatggttcattgcgttgtccacctgaattcttcacccctccctgtggctgtgtccattgccctgtagtgttgcagttcccctcaggaaaaagatatcatttacttctctgacccttgatttggagcttggctatgtgacgtgctttggccaatgggatattggatgacataacataaggagagacacagatatgcatctgcacaatgcagcttgcctttttatgcttctgccttcaccatgaaaagagctttccctgggggtagcagctgtccctgcagcctgtgttcagaatgcacaaatgtgaggagccaagcccagccagcttgaaagtgagttgccaggcccagcgcagtggctcacacctgtaatcccagcactttgggaggccgagacaggcagatcacctgaggtccggagttcgagacgagcctgaccaacatggagaaacccccgtttctactaaaaaatacaaaattaggcctggcgcagtggctcacgcctgtaatctcagcactttgggaggccgaggcaggcggattacctgaggtcgggagttcgagatcagcctggccaacatggagaaaccccgtttctactaaaaatacaaaagtagccgggcgtggtggcacatgcctgtaatcccagctacttgggaggctgaggcaggagaatcgcttgaacctgggaggcagaggttgcggtgagccgagatcacgccattgcactccagcctgggcaacaagagcaaaactccgttgaaagaaagaaaggaaagaaaggaaggaaggcagacaaaattagccgggcgtggtagcgcatgcctgtaatcccagctactcaggagactgaggcaggagaatcacttgaacctgggaggcggaggttgcagtgagctgagatggcgccactgcactccagcctgggcaacaagagtgaaaccctaaaaaaaaaaaaaaaagtgagttgcctaccctagctcagaccacctccagccaacccacagatgtgttagaaatgagtgcttatttaagtatggcattgacatgttgtgattagttgttatgcaccattatagcaaaaaaattgcacactgataaaagtaactgttccctcgttggcttcaccagctttcccaagaattgtttaatcccattccctgtataaaatcactctctgctgagaatcctttttctgagaaaagaattctgagaattttttttctgcttgaggcagaccaacactcattccaagaacaactggaaaggctgaataaaacacagaaaacttttttaaaaagtttttggaaagcttcccagttaacaaacatttgaagggtcataatctcaaaagaagaaaaacacaaggaggcaagctggccctctgtgaactacttttcccttcaggaaacgtgctgattttagctaagaggccgagcatttgggcagacggccatagctaagaggcagcaaaggcagcagagtcgtcttcagctggagagacaagaaatggagactgaggttgtcaaggcagctggaactgaaggggccgagatatcatgtagaagggagacacagaaaaggaacactttccccttgaggcatctgctgagttaagctatgcagaaaggctatgaaaagcagcaggttttggcagtgtcatattaatgagataaaagttggagttcaggacccaccaaggaaaagaagcctaataatcacatcagacactcagttggaatccttggaggaccacactctagatagacgggcaaaccagagatggagatgaagccttccaaaaactgcaacatagactctagtcagttcggtaccattggattaaggtaaaatcttcccactctgtctatcagatgacatggtaaaccctcccttgagacagacattgttttcagatcatgtttcctggagccactaaaatttattataatggttagcattcaacaataagtgatcaaacacaccacaaaacaggaaggaggggaaaacagacacaacaaaacggagccactaatgacccagatattggtgttatcagacacagacttgatgggtggaatagagactttcatcaaagaactggaatctataagaaagaatgaaatggaaatttaaaacttaaaaatacaataattgaaattaactacttagcatatgggttaactacaattagatttagcagaaggaacattctttgaactgtaatataggacagaataaaaactctaagctgaagaacagagacaaagagtatggaaaatacagcaaagaacataagatacttgtgggaggtggtgaacaggcctaacacatatgtaactggagtcttagaagggaggaagatggggcagaaggaacagttaaataaatatagcctgagaactttccaaaactgataaagctttatgatccccaagcaggataaataaaaacaaaactgcatccaggcacactatactttttttttattattattttttgagacggagtttttctttgtcacccaggctggagtacggtggcgcgcgatctcagctcactgcaacctccgcctccccaaggtcaagcgattctcctgcctcagtctcccgaatagctgggattacaggcacgcgccaccatgcctggctaatttttggattttttagtggagacggggtttcaccatgttggccaggttggtctcaaacttctgacctcaggtgatccactggccttggcctcccaaactgctgggattataggcgtgagccaccgcacccaacccaggcacactatacttaaactgctgcaaatgaaagacaaggaaaaaacagtaaaagcagctagaggcaggtaggagggacacatttcttcttttcttttttcttttcccctccctccctctctcctccttcctgcctccctcctgtcattttcttttgtagaggggggggatcttgctctgttgcctgggctggttttgaactcctgggctcaagggtgctgggatgacgggcgtgagccagtgcatgttactgacacattactctcaaaggagaaacaatagcactgaaaatcacttgtcaacagaaatgatggaagtgagaagataatggagtgccattctgaagttcctcaaagaaaaaagtgtcaacctgtaatcctatattcacaaaatatacttaaaaatgaatttgaaatagatgtttctattcaaaaactgagaaaggctgggtgaggtggcctgtaatcccagtcctttgggaggtcaaagcaggcagactgtttgagctctggagtttgagaccagcctgagcaacatggtgaaatcccttctctacaaaaaatacaaaagaattagccaggtatggtggtgcctgcctgtagtcccgctactcgggaggctgaggtgggaggactgcttgaacctaggaggttgaggctacagtgaaccatgatcatgccactgcactccagcctgggcgacagagtgagaccctgtctcaaaaacaagcaaacaaaaaaacacaaaaaaacctgagaaaatttgctgccagcagatgtgcatacacaaaaaatactaaagggaattcttcaggtagaagaaaactgatctatgatagaatcacagaaatgcaggaaataataaaaaaaaacagagtgaatatgtgggtgaatacaaatgaatattgactgcacatagcaataataataatgtctcgttaggtgtaaaatatatgtgaaattaaaatgagtaataataatatacatgcaagagtagaatggaggtaaatagagattgagtattgtgagatcatagcattgtctgggaaacaataaaaagtaaaatttgtattagattataataatgtacagaagttgtaatctgtggaggaaaccactaaagaaattataaaagaatgtgtaagtagaaccaatggtagggggggaaacggaattaaaaaaataatcagaaagaaagcaacagaaaagaaaaaataaaaacaaaaatgggtaagacaaatggaaacaagtagtaagatggtatttatgaacacaactatatcagtaattacaataaatgtaaattcacgaaatacacaaaagacaaaatttgacagacttgattaaaacaactctattcaagagacatgacatcattataagaacattgaaaattcaaaaataagggggaaagtgaaaaaaataccattgtgagtggtagagaaagccatttcacataataaaggttcactctaccagaaaacgtcaattttaaatgggtatgagcctaataacacaacctctaaatgcataaaacaaaaactaacaaaactcaaaggagaaataaacaaattcataataacagtggcaggctttatcctctctcagtaatttatagaaaaacagacaaaaatatcagtaaagatgtagataatttgaccaacctgattaacaaacttgacccagttgaaatacacataacacctgcacacaactgcagaatgcacattctttcaagtgcaagaacattatgataagaatattataggaaagtctgtcataaacatagcttatataaaaatataacagcaaattaatctaaattttatttatttatttacttattttatttttttgtttatacttatgtcataaacatagtttatataaaaatataacagcaaattgatctaaattttatttatttatttatttacttattttatttttggagacagagtctcgctttgttatccaagctgtagtgcagtggcgtgaacatgactcacttcagccttaacctcccgggctcacgcaatactcctgccccagccctccaagtagctgggacaacaggcatgtgacaccatacctggctaatttttgtggtttttgtagagaccgagtttcaccacgttggtctcaaattcctgagcttagacaatctacctgccttggccttccaaagtgcggggataatagatgtgagccactgagctcgacttaaatctaaattttattttattttattttatggccatgctccctctaataaatctaaattttaaataaataagtccaagtattgttgtgtttatgtgtataaacctgcgcacacacacaaaagtgtacacaccctgctggtttctattacaagaatgttaagtttggtttgacattcaacagtcaattagtataagtcatcacatccaaagaataaaggagaaaaataaaattatttcaaaaggtgcagagtaagtatttgagagaaatttaaccttatttgtaattaaaaaaatctttttaacagcttgagaatatatgttaatgagtacattaaaaatcctataacaaccatcaaacttcatggtgaatattgacaactctccacatgccacacccaccacccctgagattgaggatgagacaagaatacccactatcactacttatagtcagcattctgctggaggtcctagccactgcaatttgtataccaattttatatcttgcaaccttgccaaacttattagctctagtagtttttttgtgtgtggattccttaggattttccatagacaagattatgtcatgtgcagatatagttttacttctttctttatgatctggatcacttttatttctttatcttgtccaattgctcagccactgcagtttggcaagagctaaataaggcataaagattaagaaaggaagaaataaaactgtcattcacagaggacatgattatacaaaaataatctgcaaattattacaatttaaatgaatgtcacaaagcctctcactggataacaaggtcaacatagttttgtagcaacagaatctgtatatactagccataaacaaatataaaacgtctaagaataaatctattgaaggatgtgcaagaacactttactgaaaaccacaaaaatagttctgagaaacatacaaaagacttaaagtgaagagatataccatgttaatgaataggaagattgaatattttaatgatgtcaaatggcccccaaattgttctacataatcaattaaatccaatcaaattctagcactttattttgtggaaattgactagctgattctaaagtgttttatggaaatgtaaagggcttctttcttctggagttgccttgtggacaggatttgagacaacccaggccaggtttctctggtccatgggaagcatgcgtatgctttttgccctgactatgtctgtagagaacagcccaaacaacaacctcctccccatcagagcagagagccagctagtctcttgccatttagatttttcagggatgagtcagagataccagtctactctgtcctgcagaaaaggatacttatcaacttttccaagcggccctagaaaagtcactgctagtcagaaatctcaccttggaatgtgggggtggctggcatctatccggatgtcagatgaaacagaaacagttccactgtagtagcctgctctataaacacacagagaacccctattacatgtgagctatgaagctattagaaactacagctttgcggactactttgaaaatgtgcaagtgggccgggcgtggtggctcacgcctgtaatcccagcactttgggaggccgaggcgggtagatcatgaggtcaggagatcgagaccatcctggctaacacagtgaaaccccgtctctacttgaaaatacaaaaaattagcagggcgtggtggcaggtgtctgtagtcccagctactccggaggctgaggcaggacagtggtgtaagtaaacccgggaggcggagcttgcagtaagcctagatcgcgccaccgcactccagcctgggcgacagagcaagactccatctcaaaaaacaaacaaacaaacaaacaaacaaacaaaaaatgtgcaagtgaaataagtgacaaaaagcaaacacaagatattctgttcatacgaaacactgcgaggcgacacttgtgtttgtagattgacagaaattggaggtggagttaaagaggtagaaactcagtataacattcattgcctcttttgctaaagttgtttcactgcataagaaaaagatactggtcgggctgggtgcggtgactcatgcctgtaatcccagcactttgggaggctgaggcaggtggatcacctgaggccaggaatttgagaccagcctagccaacatggtaaaattccgtctctactaaaaataaaaaaaattagccaggcatggtggcgggcgccagtaatcccagctacttgggaggctgaggcaggagaatcgcttgaacctgggaggtggagggtgcagtgagccgagatcacgccattgcactccagcctgggtgacaagagggaaactccgtctcaaaaaattaaaataaaaaaaaaaaaaagaaaaagaaggaaaaaagagaaagagatagtggttccatgtgctgttctagttacacaaaacaacgtgttgacgtgcaggctgcacgatgccaggtgcaaatacacactacctgttacagtaactgtgacaagcacaagggctgctcactagcttgagtgcaacttctggggagttgatggcagtgatctgtgggtacttccttcttaacaaattttacatcaatactgcaacacagcaatctcagccctgtgggctataccatagccacatgctttcaccatttcctgctcaaagggagagcccaggaactgaatgctcttaatcagggagagcacagaaacagcagcagaacagctggagaaccagggctgtgtggttttggactgtggggagggtgggccatgggcagacttgacacaatgtgggagggcatttgacacagccccgtggaggacctaatgctcggggaggccttcacccagcacagtgagccatgccgacacttggtgcctgagtgcgctggtcacagcgccctccctgtgattttccccatagcagtgtgttttctctgccaggcagaaggcagagaaaccctggctgaaaaagcagtgagggtcatcgactgcatgaacacatcatcagctttcccagatggaggcacccaagtttaccctgcaggtccattcagcaggtagagctgggtcatcactaaacaggatctttcttctgagcatctgagattctggtccaaatcagggctgtgaggaccaggagccgggattccgagcccaggcagccccgcagataaggaggagggagtgtgtcggaaggctgtatggccagagccgctgaccgggccagggcttctttgtcccctcttctctcctgcatatcagcactcacgtcctcctggctcgggctggctggcagctcggggagctgttggatgaaacgtccatgcgtgtggctgtggctgtcacatgcaactgcgaggatggtcggctcccaaagcggaaccgcggtgctgggcgaagggtcagggctccgtggtgcggcagagcgcatgccagcgcttcaccagctccttgggcttgctgagcatctcgtcccagtgctccagctctctgccgcgggtgtacatgtaggggcccaccaccactcggcccagctgctggctctctgcaggggagggagagcaccggtgtgctcctgagcacagaagccccgtccccagtgacctcctttcctccctcctcctccccaggaggaagtagcaactcccctcctctctgagtgggagctgacaggccccaaaggggccctgcctttgctctgcagctggaagggctgcttctccccctgggagattgggaggaaggagagccctgaaagactctctccttgagggccaccagctctgccccacacccttctgtggggccgtattaagtctaccttatgccaaagagctgagggaggaaagggcccctctagaaagaaggcctcggccatccgagagtacattcagcagtaacattcactggccaccgtggagaagggtcttaagtccaggccatgtggccagccacggcctgatggctctgtttccccagagtggcagtgggtgctggggtgtggggcagtgtgggagctggctgacagaactcgcccagaaccccaaagtctcatctggagggcacgaggaaggtcagagcaccaggtccctgggctggtggcaggcctggcccctcccactctctcgggtgatttgctccaggagagggcagcagaggccattgcttaacctctttctttttcttttcttttcttttttttttttttgacagagtctcgctctgtggacaggctggagtgcagttgcaagatcttggctcactgcaacctctgcctcccgggttcaagtgattcttctgcttcagcctcccgagtagttgggcctacaggcgtgcaccaccacgcctagctaacttttgtatttttagtacagacggaattttactatgttggccaggatggtcttgatctcttgacgtcgtgatccacccctctcggtctcccaaagtgctaggattataggcgtgagccaccgcacccagccaacctctttttttttttttgagacgaagtctcgctctgttgcccaggctggaatgcagtggtgcgatctcggctcactgcaagctccgcctcccaggctcatgccattctcctgcctcagcctcccaagtagctgggactacaggcaccagccaccacacccagctaattttttgtatttttagtagagacgtggtttcactgtgttagccaggacggtctcgatctcctgacctcgtgatctgcctacctcggccttccaaagtgctgggattacaggtgtgagccaccgtgcccggcccttttttttttttttttttttttgacagattcagcagcctcgcctcctgggttcaagagatcctcccacctcaacctcccaagtagctgggattacaggggtgtgccaccacgcccagctaattattgtatttttagtagagatgagcgtttcaccatgttggccaggctggtcttgaactcctgagctcaagtgatccacccaccttggcctcccaaggtgctgggattacagatgtgagccagcatgcccggctgcttaacctgtttctagggtgccacagacagagctcaactggactaaagctgggcctgaaacccaggccttgggcaatatttcagcctttctgagcactagtttccttaaccagggagggagctcgtacagctccttctgaggtcaggacaggaggcactcactctgcctgaacactcggcagcccctcgtggtccccatcccagcagcccagggtagggtgtggccttactgtccccttccatgttctgcaccacagtcaggctgaggctagcggtatccagctcggtggcatcggccttgaagctgaaggtctcattgtacacagggttgatggagcccagcacagctgaagtcttcttgcacttgacaaacttgttgtggttcatcagagacactttgacaaacacacctagggaacggtgagcactagtgggctggcagaggcaggtgggagcagagcccctgcctgtgggaggtccggctaggagggcacgtgcccaagctaggtgccagggccccacccctcacacagtgctgcggccccgccggcgtgaccagaggaagccggctgaggagtgcactgccctgcggcccaggcggggctccgctcccttccttttccttcctctttgcatcaggaaagtacccacggctcctgcaggccctggtttaccagagcctagcaccgcaagcctgtccctccctgttggggggctgctcactgggcccccaggccccctggggccccttaaacaccttgtacagagggctaagatttggtgggtgagggtcagagtcacagtggaaggtctggatcctgcctggcttacggtgaccccagatgtgaacacaaacaggtggctgaccaccacctcactgggatgggtgggatgtgtggggtgagcccaaatggggtgggacatgtggggtgaaccaaggcctccccttctgcagctcctgtattctgggaggccaagcatcagtgcccattgagtcgggggctcttcccctgtggggagggaggtgcgggcctcaccctggaggaactggacccatgccgctgatggaaaggtggaggtggaggcaggcaggacagttcaaagagccaagacgctgcctcgggaaacaggaggggcagggcctggtattgcggctgggttagaaccctccgtaggggaggccaaggagatgcagctttgggttcaacacaggaagaggcttcctgcaccagaactgtcgaccgagggacagcacgtcttgtgaggtagtgagcgctccatgataggtgtatgcaagcagaaactggatggtcagggatgaggttggactgtagccccaggctgtaagctcggtgggtgggaccttccccaggaggaaagggaggaactcactgacaatgcctctgtcctcctggagccggaggcccttggcacgcagcacaaccaccgtcaggcggctcaggtagtcgttgtagctgaggcagaactggaggtcgccaaactccgaggggggctggggaggccaagatggaagcaccccaccctgttactctggcaagtgctgaaggggtcacagaacccccagagagcctcccgcttcctcctagcggtccatgcgacacacccgcatggtcccctttgagttccactgccattttaaggatggggcaactgtggtctggagagtttaaggggcttgtgcagtcctgtggaccagagctaaggagtcacacccaggtctgagccagctggggccttcctgggggtggtgggctggaggaaacatttccctgggctggaccatttgtggtgtcatctctcacagctgtctaacctagataagaatccaaatgtggatatttcaggttgctccagggggtctgatggccagtgtgacaacaggacctcaagcaggccctccctgcccaggggcaggtccgttcccacctgtcccatgctgcttggggcctgggccctcctccctgagtcactgttgtagggtggtgtgcaggatgctgagggctgatgccgccagcaggtgctgggccctgtgcacacctgccagctgatgctcagtggcataggcatggtgaccttgaccatacctccaggctctcggcctccaggtctctccagatgacacgccggcagtcccccactagggtctcattcttcaaggggaagagcacctggcccaggagctggtgcttcctctgcctgtccacgtggtagacggagaacttcagcaccctctgggtgatggtcttgctggacacctgggggggacaaggacaccagccagagtcaggcgtgggggtaggggatgggatggtgtgacttgttattctggacatgggtgcttttgggaacgggtgtctcaaccagggacccacatcccccaaacctaggcattttcaggggacccttctcagcagcagagccgtgtacccctggaaagtgggggtaggtgccaggaccttggtacacagagtgtggtccgaggacctgtagcgtctaccaccacttggagccctgttagaaatgcaggatcttgggccccagcccagattcatgaattggaatctgccgtttaaccggagcaccaagtgacatggctgcacggtgagtgtggctccgccaccaccctgcactgtagcaaaggcccaggagcccagggcaccggcctgtctctgctgtcagagctgggcatgccagctctctcctccctgagatttggcctcctcgcctgtgaaatggggattatgggtcttcctctctggttgtaaaaccccaatcacagtgtctgacctccagcagatggcccattaatattgattttcttttctttccccttctcccttttccacagagggattggatcaagctggggcgagatagagtggggaagtgatgagctaagaaaaattagcctgcaagcatgacgtgtcgcacgtcagcaaggctgcagccttggattctgatgtcttgagaagagcgattcacctgtgaattctcacagccctggcctcagaaagacggcccgggaccaggcccgatggcacccctcttcccagctctcagccagggcggaaggcacaagtgatggccctggcctccgcagtcacactcctcctgaaagctgactggctgaacctcacctcttggctagcttgccacccagctcttgagaacatgtttgtccaaggcctcttggcaggtctcgatgactccttcccctaagggcccccagtcacctgctaaggctcccaggcccctgtgaaactggctcggtgccccaatagactctccacctccagaccctaagccggccagcccagagtgcagcaaggcaccacacctaccctgtgagggcactcgggccccgcgctggcctctgacagcacaggaagcttctgcattcacgctgaggcctgtcttttgccttccttagataaacttgccagaaaccccatagtgcttcaggcctttgggataattcccctgagccccataggccagggcctggcattcagtagttgctctaaaattgtgttttcacccactctcttccaggtagtcaggacagggaagcccaggcttctggtcaccactcaccaaatctctcccctgcccctctatcagggatcagctcctataggccttaacctagcagactaggtaaagcagagctggtggcatcaagggtcccgggggctgcagagccctggctggtacaggaggctgggctctcctgtaggtctgcaccttcccagcaacgcggagggcaccagaccctgcctgctccagaggctgtacctgaaagatgaagtgctcgtcaaactgcgggttggaggttttgcgtttggtcttggattggaggaagcgccgctcatcgggcagcaggtagagcttcaccagggggctgcaggtctccgagggggcttgcaggtgctgtgccttgatcaagcccaccagcagccgctcagcctcctgctcatattccaccgagaaccacagccgccccaggcagccgtcggggaagtcggtctcacttttgtcctccgggaacttgtacagctctgggttgatggcccccaccatacatgcatctcctatgacagagggtgggagggctggcaggccagaggaaggcaggggcatgggagacagtggcaagctctgggcacccatccccatcctggcccatccgtctctgctgagcctcagctagcctgaccacatctgccccactctcctcaccaggctaaacacatcccctctctctggtgcagctcctccaagaagccttctcaccatgaaggcattgcatggccaggctggggatccagcagagtcctgccccctgggattggcccccatccttggaggtcaggacctgtttcaaggacacagtgcccatcacctggcctagcccccttccatggcgtctagggaatgactcagcgataaaacattgcctttcttcttcctcttcaaattagaagggccaaggtgattattgggtggttcctgtgatggtctcttggtagatcttcagggcaaagaggtggcagaaagctgtgtttgcagcccctaccattctgtcctcttggtcaaccaacccatcatcctagagtgggacccagcacaagttctgtacatggcgtgcctgggttccaattccaatctgttgcttacagcctcagttaagactatgtaaaatggggtgataattcctccccctcagagtcatggtgaggtctcactccaaatcagcacccaaggccatatcttaccctcatggggtgcagcaagcacttcataaatgaaagcacccagaaagagtggtccctgggtggtccctggcatccctggctggttcaggttgtgttccggagccaagctggtgaaagcagatggggccacccgagcagaccctgacctctgggcagccctggcaaggacactcaccaaggccgccgctggaggtgtgaggcagcagctctgatgccgggcaggggtcccatggggcatcggcccactctccactgtgcaggggcacccaatctcggccttgaagggttgggggcaccacgaatggcacagctggtggcctgtccagagtcagggagacaacatgtaggtggcaagtcaatggtgtggtctcagagcgctcagccaggacggttgagcaccaggggctggaggaagaaaagccatcgggagccaggaggaggccagggcaccattttctgggcccataccaggcaacacacacacacacacacgcacacacacacacacacacacacacacacacacacacagcagtgggatttgaagaaggaacacagcacctgacagtgtcagccagtctgggtttggattcctgttctgccacttactaattgtgttctctggacctgttgcttatgtgcactgagcctcagattcctcacctggaacatgggtttcataacacctgcctaatagctgatgtgaggtttctggggtttctttgtgatagctcccagcaccgaagcagcatagaagaggcacccccataaacagaactttccttttcgaccccaccctgagggaaattccaggggcgcacttggccccacatcctgcctcacctgctcagttgggtcctagcatgcggctggcagggcctgtcccgctgcccactggaggcagctgtggtggccatggctggtgtcccaggcagctcctcataggtgagggtggcacagaaccttctccacagacagcagcttgccccgatcaacagcagcagcagcagccccccgatggtgcccccaatcaccagggccagctgctctgggggcagagaccaccagtactatgatgcctgcctgggaaagccactctccctcacagccctggcctgctggggcagaactagggcagcaaccctgcctctgggtttgatctcaggagtgataggagcaggcctgctggggatgggttccgggagggatgctgctggctaggttccgccagctctcagaggagaagccgtttaccccagggtctgagagccctgggcagaaccttctagttttccttggaaaacagctggccctgcccttgggattctggcttaaagaagccatttccttgcgcttctgagtagaaatcaaacctgccctcaccagaacctccatatcccctgggctcctgttgaggccaggaggggagctggggtgtggacgcagtcagttaaggaaagccctgaaaggtaccttccccctggtctgcaatcaaacctctaccctctggggccctggaacctgctgcaaggctggactcttctctaacacccgctccctcccctagccctctatcaaggtgagcacgcgcttaggggagttggtgcgacgcggtggacgaggtggggaggaaaagggggcaagaccccgttgctgctggccctcacacgtccgcatttgcgggacctaggaggcttcgccccgggggtgctcagacgctgggttccaaccgctggccacctggggcgggccaaaaaggtgcctcccttagggtgacgtgcggccgcggggcattcaggtctcagggatctgcactgggtggggtggtgagaaggccggaccccccacacctcctaagccgcaactgaccgcgaagagcgggcctcagcgtctactccatcccagtgcccctccaagagcgcgccgaggccgggcagggcaggcgctgcaccccagcgggggcggcggggcggaggcaagtgctggaagggtcgcagaggggccggggctgggctggggaggcgaggctcgcttacccgccatggggctgctcccgcaggctggtctcgccggtctgggcggctggggctgggctgccaggccgtctcttaaagcgccgcggggcgccgtcgggcgagcacaggggcggtccgtggtgctgctggtgcccagctgcggcgcggggagccgcgcagtgcacggcaggggcagggacccagcgccccgaggccgcagtcccgccccagcccgtccctggcccaggcccaggcccggcggtggaggggcgcagagccgaccgtgagctcccggaaaccgcagggctccagccagggcgggtcccgggcgccaggggcgccaggggctccctgcggcttggggcagggtggggtgagagtaccacccccatcccggagagcagggctacagccttcaccgccgcgtctgacacagggctccgcacccgacccctcacacctggtggccaggactgagcccccgccctcccagatcctcctcaagccgaggcccctccagccgcagctccgaccccggctcgggggagccttcccggatcccggggtggagtctccgcgcgggtccccggccccagcgctgcctgcctgatggccttgggcagggatgcggcgctcgcgcacccgttcgctctcagcggacaaaccggtcgagagcgcaattctggagcgggttccagaagctcctgggttccaattcaggctcctcactcgccagccctgcgatttgggacaacttaacgttcgtaagctgggttcagtcttctcaattgggttaatgtccgtgaggggctctcgtaagggcggctggcctgccggtaacttaagaagcatgtaaagagcacttagagcggaggagcggcgcggcccagcccctgttacggtggttatcggatggaggccagcgtcgcctgggtcccctctgtacacccagcgcctattattatggtgattattagaacgcagggcccgtgcccactagtccaggctggcgaacgcgccttgcgggaaaggcgggagtaaggtcgctgcgtgtcctctctggtcacacctcggcgcgccctggtcgcgcccctatggttcccccgccgaggcctcgaggcgtctgagtggggagcgaaaggaatgtgtgtatctgtggtgcaggggagtgtgtgtgtgtggggggggggagggggtggttgtgggggagtgcgtgttttggggggatggaccttctcgttttacagccttgaaggttatgtccagagtcatagcctgggtcccacacccccgcgtcacctgtgcctgtcctagggggcagtcagtgtgcgtgaggctccaccctgcctgggctttggctcacctaaggcgaggagggtggtgaactggggtgccccactgggccgggtctgggagccctcagcgccagggtgcagaggccgcagccactccccttctagggtctgggcggtgggggcatgagaaggcggagacccaggccacttcacccagtaactgtcctcagctgtgcgcttaactggcgagatctccgctctacttggagacagtctggggtgtctggagaatcctcccccacttctgcttaccccaggtcgctgtgggagcaggtgtctcaggaaatggggcctgggtcccacccaaggcctcgggtctgagttagatgtctgtatgtttgttgttgcccctgcaacaaagtaccacagattgagtagtttaagccacatgcatgttatctcacagttcggggggtcgggaatctaaactgggttggcagggcctgtgccttctggaggcaagggagctgtttcccagcgtttccagctcctagaggctgctagctagtggccctttcctttgtcttcaaagccggcagcacagccttttctaacctctcccactccaggtcatttcacatcaactctttctgcctccctcttgtaagtgtgataccctaccttgttttaacctgaattgactgtcccttagctgagagagccagacacactccattttggctccttcacttgcagccccttacccaccccccttcctcaaggacttaacttgtgcaagctgactcccagcacatcaaagaatgcaattaatggataagatactgtggcaagctatatccgcagttcccaggaatttgcccagttgatagtaccctaagcccccacatttgtgtccggttgatggtacccaaagcccccgcatctatcgccttgtgatggatttaaaacccctgcacctggaactgtttgttttcctgtaaccatttgtcttttaactttttgcctgttttgcttctgtaagagtgcttcagctaggctcctcctcccctttctaaaccaaagtataaaagaaaatctagccctttcttcagggccgagagaattttgagcactagccgtctctcggttgccggctaataaaggacttctgaattcatctcagagtgtggcgtttctctataagaggctcatcagataatccaggataaccaccacccccatctcaagatcattaacttaatcacacctgcaaagccccttttgctatgtagtcacggggttggggatgaggacttgatatctctaggaccattgtgtggaccatgttgtccatgcagtaccctgggaggggtggcttacatttccccttcctctgtctagagttcagtgtgcctcaacactggactcaggcagctagcaaggctcaggggacccctacatggaacccgtcagctatcttgaccccttcccccagctgccatgcacccccacctgaccaccccaatggggcatggcatccacaccagctgcctccatgattgcgcccgagctgtactcaggctgttctgggggtggagttgggtagtgggatgttttttgaaaagggaatcccttctggcacttcctgagtgccaggcccagagctgccatctctcgacccccatgctgtgcttttccaaagtccccatctttctctgtgtcaccaagtcctgacagctgttcctcctctgtccatctctatcatggcaaaaaaccttgcccagccctccatcacctctcatctggagctctgcatgggcctcctctcagctcttcagattccatgctgcacccactccccttcccagctgttgtcttccaggctcccctcccattctcatcccccccaccacccatctctatgcagtgcttgtgcccagactgatgcagctacttccacggctctgcgtatgcactgggctctcccaccatgctgctctctccctgtctgaaatactcaatgcccctcccaccctccttctccactgctcatgtttcaagatgaacccccagcatcttgccttctgtgaaacccttcatcatcccctccttgtcctcatggtccttgcagctaccatgccgaatatgggactctgtgcctgagactgctgcctcactcttcctggcagccgagggcctccatgaaggcagggggccgtgtcttattcagcttggcatcgccactatccacctccagggctgaggctgtgctgaatggcagatgaagggctcttgccattgggatgagctgccccagcttctgcccacattgtccatgcatcatacacatcctgggctcacaatttagggcccaacaggagctccctgccctggtcctgcagaccagcttctggggtctgcaaaatcacgttgtcagctctatctgcaaaatccttacactgccagccagcccactgagttttgagtcaatcttcctccacgggaagataaaagcaggtggcaggagggagctcatccttcttgctgctcctgatgttctgagcattgagatgcaggcctgatgtacacgatcccatggagccctgcctcatgtctgccctgcagggtcatgacctcctcctcagatgaggaaactgaatcaaagaggtttcctggcccacccactaagtggtggatctaggcctggcacctggctccctcgttccttcttcaccagtgagcagctgtagggcaaggacccaggagaccctctcctgtggcgctgaccgtgaatcaggcaaagagccacaggcactttgggcagcctcccctccatccactgcccgggggctctgagacctggctggcctggagccagctccccagaacagaaaggcatccagggtctggcagcagctctggctctgcttcctgttttcagaccttgttcttccccgtgtctgtggagctgggaagcctggaaacagcagcagacatgggttctgtctttcatggccaagcggaagttttatttccatggcaaaagcacttccaaggagggctgcaggaagtccaagagtttaaagacctgcaaatgcctgcaggtgattaataattcattgcagcagatgattacgagaaaggccactttcaattaaccttaagaatcatccctgtctaaggaagtgtcatctctcatcactgaggaacacagaggccatagcaggataaaggccacgctgagaagcatgtggaagactgtgtttctcaattcatgcaaattgcaccaggtcagcccaggtccttctttgtgaggagggggagggttcccctgccagcatcctgtctgctctttggttctgctatggcggcctcagacttaatttcctccagccccttcttttgaggagcttggagggagtatctttccttgttggatcagaacttctcgtcccccactgaaacatgctggctccaaattgtgtctcctcctgcagacagtcactccgactggcagggtgggcttgggcctgtggctcgctcctgcccctgggcgtggtttctgcttcctgccctgctgctcccctgcctggcaggcctgctcccctgcctcctctcaaccagcaccagaactctgccttccctctggagggaacaacttccttccccttccctgtccacacagtacctggcactcccctactcacccctattctagcgctttgtccatgacccaggcctggctgctcagcctagttcatttctggctgcagtgataggttcagggatgtccctgtgaccccaccccctgcccccgcgagaggctaatcaggatcaacactggaattttgtgggatgtactggggaagagacacctcctttctggcaggagttgttgagcagaaggagctaagtctggggccatggaaagccccacgtggaggagccagagaggatggagccagcacaggtgctgaggtggggacctatgttgtcctggcagcccctgcatcctgctgcatgcagcccctgcccctggaggggtggagagagagggcggcagaggggagtgagcccgccaaggccactgtgttagcaaggagctgagccggcgttggcatcagctgttccagcttcagtctcttgaccaccaaggctgcccctcagcatggagcagaagtcaggaactgaggcaaggcttgtccttcctcaatcgtcacctctgggcactcagctgtcctaaagttttttgaccccccttagggatggggtcttttcagcaagggccatttgtggcaaacaacaattaatttactgctcagcctccatggctcactcctgcccctccgccagcttctgtgctaacaactgacccacatttttttttttcaggaacagcaatgtgctcagtcaccaggcatgcatccaatgagccataagagggcggaaagactttgttttttgatgtattaatatgctaaattgatgtgtcggttaagacatgaagaaattagctatcaaactccaaagagtggtgacagactaagacgcagatttccaaaggtggctgagaacctgctggacaactgtcccccagtgagaggaagggctgagagagtgagggagggaggggatttgccagattcctttcttgagggctggggctgtgatgtggactcccacctcctacggctggccagggctggggaggggggtgtgctcggggagggggctgtgctcaggtagagagggggcaggtggagcagaggacagcctcccctccagcccagagagttggggattcaactctgctctgagagcttgctttctgtcccctggagtttgggaggcagacggactgctggtggaggtgcacaggcaattgtggcttcttggttctgatgaagacagtaggcagctgctgtgttgggaagcagccaggctccctcagatgccagccaaaggtttgtggatcttgggcacatgacacgccactggtagtgcgagtgtggctcagagtgtgatggggaattgtcactgacatgtgcctggggacttgtcaggatgtggaatgtgtacatatttcccacaaccagacattggccatgtgaatgaaagagccggtgtgtgatcatctcagtcctgaccacaggccctacccagagggcatatgtagcacagtggaaggaagtaggaggtgaactttctaggggtagaggagggagcaagtggcttctgattcatttgctcaggtcaagggcactctggttctggagtgggtgtcaggggtgaaggatcgagggttcctttcaaagggcccatttgagcatgaaacctcttccagatctggagaggtaaggcatcttacgagaccgtcaagacagaactttccaaatccccttcccttcctctgctcatgctcttacctcagaagtctgctacgggcagtgagagaggagagaggaggctgaccatggcaccctctccaagggcagaggctgtctgtggctggccctcaccatgggagatggggagacttaactcaagtttgcagatttgattattacctaggtggcctttctgatgactgtcttgggactgcggggacagtggctagaagggaatgatctctgctgaatacctgctccttccaagtgtggcctccatagggagctcggggctctcacatgtcctcctttgttccctcaaatagatcccaagatcttgaacgagaccattttactgggctttagtgctcaaggctgaggtttcacttccataaaaaaatcagttaaaagtgctgagcctgtgggaaggctgttctttggttaccttctgtggtcaattaaacgattggtctcaagttctctcttccctgtactggtattgtactcccacagccttgcaacatggtgggtgcattagactgtttatattgcttataaaggaattcctgagactgggtaatttataaagaaaagaggtttaattggcttacagttctgcaggctgtaaaggaagcatggtgccagcatctgcttctggtgaggcctcaggaagcttctactcatggcagaaggtggaaggggagcaagtgtgtcaagtggcaagaaagggaacaagaaaagggatgcccacttttttaaactaccagatcttgcctgaactcagagcaataactcactcattactaaaaggaggcaccaagccattcatgagggatctgctcccatgatccaaatacctcccaccaggccccacctgcaacattggaagccacatttcaacatgagatttggaggggaaaaaacttccaaaccatatcagtgggacacatgcttccccatgatttgactttgagcatggccacatgacctgcttgggccactggaaagttggcagagatgatgcggcagaggctggaactgcaccgtgcggctggccttgctctcctgtgctttagccaaggcggtgagatgagcatggcccagggagagctggctccaggccaatgagtgctctgtggtgcaggtccaaaccccacctggagcctgagatcaaggagttcagcctgagccagcagaccccagccaacccacagacatggaagggaaaaataaatgcttctggatgatgccatagagactctgtaagcagcaaaagctgagcaaaacactgtcactctcttttgattcctttggtgagactagagctgtgagctggcagggccacaccccttgtcccctctccacatgcctcaaagttgtggctgaaggtggatgatcttgtcacttttccttactggctggccttggtcttctctggaccagcctctgctgctgtgggaggaataaagtgctaaggggtagtgggtttaggggaaagagagaaggcttgtgggggacatctgaggttttcacacagcatactttatccttcttttgttgcagtggtgccccagtcaaaagtgccctctgggaaagcccttccctcctcttgggtgtggttgactccaccctcttcttcttccagctgggcttgattcctccacaggtccctcctcctggctgcagagattggttcagggaaacacagagccaatgagctgcaaggctgatttttctgacaatgctggacagaggcaagggttcttcccgagggtcttgaatttaatgagagaatctcaaatgatgagaaaaaagctggtctgaggacagggtcagctgaataggtcgtacccagagaaagagagggagagagatactggatgctggtgatgggtgaatgagacaaggcatgaagctagaacaccacctggtttttcacttaggtgagcccacaaattccgatgtgtacttaatgccagcttgagtaggtatctgccatttgcaatcacaagtcttcaatgatacaagattgcccacctgctttgggccgtctgtggcccaaatttgtacctggccttattttagggacatacacctttcttgggtttgcacacacacatgtgtgtttacatttggacatagtagaacaaaataatttatataaggattttgaaatgctgaccaaataaataatctacaccaaatactttacttacgttgttttattcattcattctttttaaaaaattatttattctttacaaccaccatctatggcaggtttttttttttgttgttgttgttgttagatggagtttcgctcttgttgcccgggctggagtgcaatggcacgatctcagctcactgcaacctctgcctcccaggttcaagagattttcttgcctcagcctcctgagtagctgcgattacaggtgcccaccaccatgcctggctaatttttgtatttttagtagagatgtggttttaccatgttggccaggctgatcttgaactcctgacctcaggtgatctgcctgcctcggcctcccaagtgctgggattacaggcataagccaccatgcctggcctatggcaggtacttttatcacttaggaaatcttttggttacaatttacagtaaatctgactaaatctgactaaataagcctaaatagggcttacaccataagaagatttgctttcttatttcattagctctaagatgtcattgattgtgaaatgcaccactgttttgcaccactttctttgtataagcaaaacttgctgccaaaccatgaagccattctttactatcaaatcagatatgagaagtgacagtggtgtcagaatgtgaaaaaaaaaaggccttccttggaatggggagaaatggtgttacttagcaagacatttgtggttgggtagcctcagatttgacttggcagctcaacatcatcatctaagatccaggttccttggatgtgtcacctgctctgccaccttcaagtttcgagatggcttggtgtcttctaacaccaagttcaaaggcaggaaaagaaggaaaggaatctgatagggaaagtgtttatttcctcactcacatccctcatcttatcagaaagcctccggcacactgaccctccataccttgttgctcactggcgagacccacacacagccatgctggtttcaaggagaccaagaaagtgagtatctgaccttttcagtcctataatgggagactggttgaaggaagaggacataagaaatggctgtcaatgccacgggatttcaattccaattttacagatgagaaaactaaagctggaagaggttcggcaactcgcccaaggtcacacaactagaaatcggtcaaccccagatttgaatccagtgtcgaatgattcaaagttcttcccattgcaccataaatcatctgtacatgaaagaccgaagactgagaaacctcaaatacagagcaggtaaatagtaaggaacgtgtttggatgaaataccagaacacctgaccatcagtggatcagataggggtttattgttgttatgtagccagcaccccagagatcagcagcccagggtggcacagatgcttaagggtttcatcaagatcccaggctccctcatcatcctccttcaccttctggagtgtgtggtttctgtccttaagttcacagtatggctgctgcgtctcaaggcatcacatctagctttccaagaaacccctacctagtgattccctcttacatctcattggttagaacaaggtcacgtgtaactaaccccagatacaaggaagttacaaggaaaagtaaatatatttagctagacaattgtcatcccagtcaaaactggtgctctgttttggaagaagaggagagagaaattgggtagtggttgtcattagtgaagtgggtatttggccactatatttggttttctttcttctaggcagatggtacaacccttggggttagttaaggatgtgtaacttactttgatcaatgaaatgggagcagaagtgagatgtatcactttctagtggaagctttaaaagttggtgcataaaaagacacatgcacccatatgttcatcactgcgctattcatggtagcaaagacatggaatcaacccaggtgcccatcaatagtgggttggatagaaagaatgttgtgcatatacatcatggactactacacagccacaaaaagaaggaagacctgtcctttgcagcaatatggatgcagctagaaaccattatcctaagtgacttaacataggaacagaaaactatatactgcatgttctcacttgttaaatgagagctaaacattgggtacacatggtcataaaaatgggaacaacagacactggggaatacaagagaagagagggagggaggggggtcaagagtcgattaaaaactgcctattgtgtactatgctcctcttgagtgatggattcatttgtcctccaaacctcagcctcaaaatatacttttgtaacaacctgcacatgtaccctctgattctgaaataaaagtttaaaaaaagacagttggtacattgttccccaagttcttttccattgatgtgatgactgtaaaagcaaatgccaagagtcctccacgatgaacagagccctcttgccaaacctgtgataggcatagagcaagggtgggaaatagacttgtgtttagttaatccactgctatttttgtgaggtcgctattgcaacataacccagactatcctgacacaggtcggcaatcagcagtgtccacacatagtcctcaagcaaggtcatgatcagaccagggaggagccagggcctaagcctgaactggcataaacagtgccccaatttctccaaagtgaggactgtgccagtgggcctcaagacaagaattgggagtccacagctcccagacactggggaccccctcctatctggagctgcctggctgccacatatgagcctggtgacccagccacacccaccagctagctcatcagcagtgtccatgtcattatcgaggcagagaaatccactcagcgaggatttcccacgttagcccagcatccttacttctcgctcatagtaacagaaaccatgttcccgcctccaacagatgcactgtgctctgcactcccctggtcagcgggtgggtgcatgatgcaaactgggccagtcagatgctttcattctgaaacttgaatcttgagtgaaataagccagactcattggggactgattggaatttactcaccccggtggaggcacatggaagaggcccgttgggtcctgctatctatgtcctcagagcttcacttaccacagttcggagaggacagcacatcctccaggggttctgaacctgaatgcagcaactggttgagaacctgagttctgcgctgtcttctgttgcagtgggagtgagtagggttttggtggtatatggtataactgccttatcttgagaaagaatattttaacagctgtgtttatgtcaagaggggtatgtgtaacattcaacaaccaatgctgcagattgcagaggacatttgttgtttttgcctgctcagcatctattcttgctgcttctggtgacaaaattcagtggtcccatttctcttttaactccagagctagatttgatccagacctggccagtcagagcatcacatgctgcaggcctcagtgagtggttaggagctgggcagtggcctaccttagtttactatgacttgaacctggaatttgtgggcaacttttgggagccataataacagtaatggcagctgggctcacacctgtaatcccagcagtttgggaggccgaggtgggcagatcttttgaggtcaagagtttgagaccagcctggccaacatggtgaaaccctgtctctactaaaaatacaaaaatcagccaggcgtgatggtgggggcctgtaatcccagctactcaggaggctgaggcaggagaatcacttgaacctgggaggcagaggttgcagtgagccgagattgcgccactgcactccagcctgggcaatagagcgagcctcagtctcaaaaacaaaacaaaacaaaacaaaacaaaacagtaatggctagtacagttaacttggcactgtccttgttccttaaactcttgtccatggacttagagctgtgaggacataaacataatccaggagttcccaagacccactatgtagggagagcctggctaaaagagagaggtgccagttctgatgacatcatttaagctaggggctctggccaagcccggttaccctggactgttgacttacaagaaacagtgaaaagtccctttggtgcttaagccaatttgagttgggtttctgcctcttgaagtcagaagagtattgcctaatacaataattctgtgtaggcatacaagacacatcagtggtggtacctgccatgcccgcagccctagaggaggagacagccagcaggtggccctattttagatcatgtaacagttggacaagagcaagcaaacacctgactcaggctctgaatcaggctggtcaggatttgtgagttttcctctggcattaaagatgacctatgtctatccaatttctcttttttaaattggaagttgagaaacagggcaggagcgagacagccagctgcaagggaagaagcatgaaggatatgtgaagaggtgccactaggaggagctggcgtggtggcaactcagtttcaaagcagcagaaattcagcatcaggagagggcgccagttggtggaaagagctggcagagcacagtcaggaggaaacctgtctaggaagctccatgaagagagggagcaatggctatttctgaagttgtctcgcctattcctgaggacttttcaattctggttcaaatcctcatgcatccttataacaaacccattttttcccccaaacaagttgcaggtggtctgagaccaaagcagacatcccccttccatgttgcctctgtaaccctcccacggtgaccagcgtatcactaaggacacttttggtagcaaaggatggaaatataatgcaaattggtttttaaaaaaggaaatgtattgtcttccttaattgagatgtcaagggatgagactagccttagtcctcactgaggtcaaggctcccgggatgttctcgggaacttgcttctgcacatcctcactttgtccttctctgggcggctccagtatccggcttcatgtaagatggtggcttcatcgccacattcccttggggaatagaatgagtttctttctccagattcccagataaagtatttatcattggatctaagtggggtacacacttatcctgaacaatctctggccaggaaactgatacagtgattggctgaggcctagcatacacccctcctctaagacccacatgagcgtagaggaggtagagtgtgagtaatatctttgtggaatatatgttgaactgctggaagagagacttcaaataagattggcttaagcaagatagaagtttctttctccctcacctgcctgcaggtaagcagcctgggagcccaggtttttttttccccatcttgttgcttctctatccctaggtattgtgatgtgagatgtttcaccatcacctccactgcctagccagtggaaacggaaaaggcggaagaggagggctcgcccctctggttaaaagtgtcacctctccctacttcaatgctgctggtcagttacttggccaaatatagcttctaggaagtgaggaaatacagtattttttttctggatttccgtatctccagataaaaaacaagaattctttaaacataggagatgagtgtgatcgggggcaattagcaatctcagccccagcctgtcccattggccagtcaaatttccatgtgtcccctccccaggggagacaaccctaaagttgcatccagtgcctatgtccagctccaagcctgggacctgtggagggacagcctgcaccatcagatctgatgtggtttttgttttatttttgtttttttagacaagttctcactatgttgcccaggctggtctcgaactcccgggctcaagcaatcctcccatcttggcctcccgaagtgctgggtttacaggtgtgagccaccacaccaggcttctggatgcagttctttatggtgtgttgccccggaacccttacatacattgcctgcctccttacacccaatatgcaacagccagtaaaaataagataaacatggtgggaaacctcatccagaagagggaaaaacacacccaccaaatcctggtgggcagaaattgtgaaggctcccagggagtggagcagagtccttggatgacagcgcctctctccaggagtattccctgggatagacatctttggaccttggtggtcccctctttgtccactgccttccatggcacaactaaagggcatcaaacggtgtatccctcttagggctatacagcttaaacatttttttttagagagaaggtcttgctgtgttgcccaggctggactcgagtgcctggggctcaggcaatcctcccacttcagccttcagagcagcagggactacaggcacatgccaccacactgggcctgggctgcatagcttttgcagcccactttttgcaggtgcaggtttggtgggtaggggtcggttgatttaaggagtcaaaaatgcagacttgtaccagccagactcatggttctttggtaacacatgccccttaaaatctcagttggctttctgcctatttgtggctagttatcctctggggcaagtacaggttgggtatcccttatctgaaatgctcggggccagagtgtttcatatttcagattttggaatatttgcattatcctggctgaacatccctaatctgaaaatccaaaatctgaaatgctccaatgagcatcatgtgtgctcaagaagttttggattttagagcattttggatttctgggtttttggtttagtgatgctcaacctcctttagattagcagtatttaagcctaaaaatggtggccttttatttatcagcctgtatgttatatctattcacctccctctcaacctgagaccagcgaaaacactcaacttggactggaaggcagcttccttgatctggtctttgtggccgagcggctgtcattgtcaggttgagaaacgtaatcaagtgtttgagaaagactagggtccatagtctcgtctcctgctaatcctgcttcttcagaaaattattctatatctgcctcagtttgtggtacagaagcaatagatttttctctttatttttttaaataaatataattttattctaaaggaatattattatatggcaacactttgagaaccataaaggtgcctttgaaatgttgttagaaaatcacttaaatcatattttttattaataaattgatgccattttcaggcacagtatttttttgggcaagcactgtacagcataattcaaaatatacccatttacagaatccaattaggtatttttctgctcacaattatatgatggctgatttctgctcacaattatatgatggcggatttctgcctacattatgatgtgatatgatatgatatgatatgatatgatatgatatgatatgatggctgatttctgcctacattatgatatataactgctctacagaacatgaaacagaatttcataacatcagttatatttacactctactttaaaaatctttcaagatataagaatcaagctatcaaatatggagtttttaacaagcaatagtttttttttttaggtctgaaaactttttaaactgaggttatagcccataggcaaagggagcttctttcagcactgctgtattctcttcagtatctgccttcctcgggctagctctgtccacgttcttctgggtcatgtaggactctgttgagagtggcaagaagcatccagcaaacacctgcattctgaaatttccaactgtttcctttagagcaagagctgactttgcaaggtattgcaggaatcagttgatcgactgctatggcatggcataaacagggtttccagatcatcatatttatgtatagcatttaaaatatgttttcagttttgttaccagcaacacagcccttcttggtaataattagtatacagcctttactaataattagtatacagcactaataattagtatacaggctttccttctgcaagagagcactcaccccaaatagtgactgaaatagactggaggttaatttctctttcatggaaaacctagttagagctagtccagggctgataggcaaccacagtgtgttgggacacaggctccttctcttttgtcactctgacatccttagggttttagcttcatctgattgatataaactggcttcacaccatgacttcattcctaccaggggagagggaaaggggcgaggcacatttcttctgaagtgcatgaccgagaaattgcaaaaattacttctgctaacatctcactgctgagaacctaatctacagcatgttgggtgcacgatgcctgggaaatgtggtcattattctgggcagttatgtactcagttagaggaattctattactatagaaggggacaataagtattgggggacaattagcagtctctgtctcgggatgatcccccaaatgaaatgggggctggattgtggggagctgaaaaagcaacagatgtctactacaatgcctctcctctgagcactccagccccttctattcccttcaatccttgtgacctaattgtcctttgggcatctgtctcaggtcccctgaatcccccatcatgtaggctttggggccaaggcacctctgatttagcctatattgtcagcttgcagctgataattattattagggactcaggaaaatgtctgtggaactaaattgaggtagtaataggcatttctgaatcaactgccttccattcattcattcattcatccagccagccagccagccagcaaacatctattatatgctaagtcccagggagtcagtgtctttttgtcagacaaaaagacagccttttcatttatggctcttttggctagaggggtctcttgtaccctagagatattttgctagaaaagcagatgctgtttaactgaatcaaagctctctcttccttaggcattgatacatcccaacttagcatttcctcaaagcttgcacagaggctgtccccagcggtaatttgtgctttgggacagctcagtatcaggttcccttagtctggcaacagtgtcttgccctttcctttggggaaccactcttcactagtctctgtgacccactgtcagccctactgcagggccccaccattttgggaagagcagtgacacaggctggtcaattgaagagctctctctctggtccaggattgtcaagtaggggcagtaagacttgatttgtgggttgtttagatccagagatgtgaggatgtagatttaaggttgccagcaactttctttcccaagaggagagagactacggtacctcagtactacccccatcatttcttcttgctctgctattacataaagaagtcacctctttcctcctattgaactcctgaatctcagcccattgaggaccttattgccagtagcaattctggctcctgtatctcctgtccactccttctcaatgggtacttctccctagcagtcaaatgtgctcagttcgttacaatgtgcagtggatacttgtttctggtcactcaggcttcaacctccctgctggggaaaactgtcttgtgagcagtctcggtggggcagtgggtgatcctagagaggcattgggccaggtattcctccaggtatgtcgatccaagggcagagggcatgtggccatagctcggccaaacaaactgccactccactgggattttgaatcttgagctgagagacacaccaaggaccatggacaggaatcctttctgtggaggtggcactggggagcaagtggttcctcctgttgggatctggagtcacctggctcctgccttgaagaacatggctgaaagcattagcatctggagatccctgcgatcttttgacatatccccttttgcttaactttttttttttttttttttttttttttttgagacagactcccgctctgttgctaagctgtagtgcagtggcacaatttctgctcactgcaaccgccacctctcggctacaagctatcctcctgcctcagccttgggaacagggggactacagaaacatgccaccctgcccagctaatttttttttttttttttttgagatagagtcttgctctgttgtctagactggagtgcaatggcggtgcgatcttgactcactgcaacctccgcctcccaagttcaagtgtcctgattctcttgtcttagcctctcaagtagctgagattacaggcagacgccaccatacccggctcattttttgtatttttagtagagatggggtttcaccatgttggccaggctggtcttgaactcctggtctcaagtgatccacctgccttggcctcccaaagtgctgggattacaggtgtgagccactgcgcctggccatccctttttgcttaacttaaccagacttgctttctgttgtttgaaataaaagaaacctactacaggatgcagataataaaacaagcaagcaaacaaaaaaaaatagcattaaaaaaatgcctctcttgaccctacattccttcccaagtgacacctttcttctcccctttatggctgtgtttaaaagaggcatctgcacatgcaccatctctggttctctcctccagctcatcccccaacccacgccagtggcttctgcctctgccacctcactgaaggagcttgctccaagtgccctgtgtcaccatgatgtcccagtttcccactatcttttctgggtgctcctccatcctttgtcacctggtgactcacaaatgggtcctaagccctctcctcactctactctttccctgaagaccttatccacccctgtgacttcagcaaccaccccatgtccatgacacccagacttctgaaaaactccggtccttggctgggcatggtggttcacgcctgtagtcccagcatcttgggaggcagagggggcggatcacctgagatcaggagttcgagacctggccaacatggtgaaaccccacctctagcaaaaatacaaaaattagctgggcatggtgatgggcacctgtaatcccagctattcaagaggctgaggcggaagaatctcttgaacccgggaggcggaggttgcagtgagtcgagatcacgctattgcactctagcctgggtgacaagagtgaaattccatctcaaggaacaaaaacaaacagaaaaacccctccaatcctgtaatgtgcaacccacctgtccacgtggtgcctcaaacatcccagtgtgcccccgctggacccctgagtgcaccccacactcattcctcttctgtcagggttcagagtctcagcaaatggtagttggcccatgtggtcctcaggcctgagctgctctctaccaaagcaatctacacatatccatcccttccttcccccatgcagtgcagcttgtacctccaggacctgacccaggaggagctcagtaaatatttgatcaagtgactgatagcagcgataacactccacgggacacgttcacaaacaccctcttcccccagccctgttaggtaggtataattactaccactctgcagatgaggaaactgatgcccagagagatgaacagttttgcttgggtgtggggttgcacagccagtgaatatgtgggggagttgagattggaatttaagtgtgactccccatgctgggttctccctggacagctgccacagccaggggagcctccttgccagggcatgaatggaagaagggggccagttggacaaggagtgatgccctggggtgagggccagccagctgtgttcacaggtagattgcatggcagacatctcctgacacccagccccaagaaggcttccttgaaacacacagtgaggttcttggttcttgagatgtcctgggagctgagagccccaggtttggggcctggatctggcaccaactctcagtgtaaccacaagcagtccatcccttcttggggctcagctgacttcactaaagagggaatatgagtaagatgcctaagatgtggaagcagaggtcctaattcctggacaggggcagaagtgggtagtggcctcggcaaacaaatcccctatttgcctcctttaagcaggatccccctaccaggcagtgtgtgatggtgaggcccaagcctggggtctgacgtcgacacccctgtgggcatttggccaaaggcagccatctgccagaatctgagagctgctctcagacctcgctggagagggctacctggggcagtctgagtctctctgggcagactgaggtcctttgctacccaaacggggagaattagagatactgttggctcctgggcactggaagggaggaacgcaggcctctcagcacagggctgggccaacaagttgggggtcccggcacaggggacaacggagaagtgccaacattgggacccaattatgtgatactggggcccagagatagtacaggtgcctcataccacgtggccctgggtggacagcaggaatctattgcgagtggcgggaggccggggctgcctgtcctgcgccctgaagctggccagcggttgtggaaactgggggatattgagggaaccgtaggcccaggtcctcagcctcatagtgtggaacctggcgatcccagggcctgggctggcccccggcgtcacgggaccgggaaggcgctgtggtgctgcggggaattgcggagaagaaggcgggctccagtggaggtggctcatccccgcacggtcactgccctcgcccgctgttggggtccgcggctgggagactgaaggcctcaagtcgggctgggtaggggcacgtgggcagggaaaggggtggtagattaccagtcttcaggggcggggctggagatgcaaccctagggaaggagtctaccaggctgggctcttgaggggcaatggagggctccgggggccaggccaggccaggatcatggagttcaaaggactggagtgaggtttggggtccatgagagtggagctcagaggatgggacggtgggtccaggatttgggacctggggctggaaagtccgaggctagtggagaccaggcctggtatcccagacgaaagggccctataggaaacggggtctcgtgggcgggatctggagccagagaattgtgagaggcggagctaggatggagaaggcgagaggaaaggggtagccgccggcgcggagacctcaatgcggggcgtggtgcggagggggaactggagcgaggggcactggagcgagggggtggggctacgaggaggtggacttgaggggctgggtctggggccggagaatcgtggggagctgcgcctatacacccgggacggtggggttgcgtcggggaagtgggagtcttgggggttcgctgggcagcctggagaacaggcggtcgtggtgcgggcggggccgaaaagaccgaggacagtggggacccggcctgaggaggggtcgggaaggaggggtgggggcgcgcggacgcagatcccgggccgcggcggggcggtggcaggctccagagtggcacgggcccaggtgagcgaggtctccgcccgccgcccctcccgccgccccggtgccagctgccccgctggcccctccctgtacccggcgcttgctccgcgggccgggccgacggcggcgggcggcgtctcgcgcccaggccaggtcggctctggctccatcttgggccgcggcacctggcacctgtggcggccgcaggagcagcgcttcccccgcctgcgcggccccggcgggcgagagggtgagaggctggctccgcgcgctcccgttggggcggggggcgtggtgggcggcacctcccccttgctgagcctcagaacccactccttcccgctgcctgcgctcagacccccggcatcctggcccctgcccagcgcccagagcccccggtggccgcatcgcactccccgcgctccgcctctcattgtcctgtcctgtcccctcttctacgtctcctctgcccatcctcccattttcacaagtctgtccgggaccctgtctccttcggcctccacccctgctgccatcgctcctccctctccccttcttccttttcccctccctcagcctactgcgccgcctaccccgcccccagccttgctgccctttggcttctcctgtcccgcatcattaccccggcccacagccccatttgcctgcagtcgctgcctttgctcctgagaaggtctgtagcctcgtttcgggcccgtattgagcccccttctccctaagtccgggtgggctttgtgcaggaggggcgggaggggagctattctgggcgaggctgcgtggtgcggtgctttcaggcctttggccccgcagcaggggcggcctgtgcttggcgtgcagagtgcagctgggtagacgctgttactgcatacgggcctgtgtgtcccaggctggggcatgagtgcttgtgagcgtgcagatagggacacaccggccgcctaggctgcttctaggccggggcaccctctccacctaggtgccccccagggattgtgggcaaatcctccccaggggaggaagctcaggggctgttgggcgcctaggcctcttcctggtgagcagagcctcatccatggggccactgaccccacagttaccccagaaccctttcctggcacagcttgtgacccggggcatgtagcccttaaggcacgttcattgtgaagggcaggttttgtctcctccaaaccctccctttaggaatgctgcctgctgctttgcccagagttggccctgagtgttcctatcaggccccgttcactctggggtggattaaaccacctcctggagggtgctgtatccccactgtgcaatgggggtttgtgctgtgtgcattcctgcctggtccttgagaggtaaggtccatattttaacatagaaccagttttcctgcctgatcatataggtttgcttttcctgttttggttttgccggacacataagtcatcatccaaatgcttgccacttaactagaggggacttgggccaggcgctgtggctcatgcctgtaatcccagcactttgggaggccgaggcaggtggatcacctaaggtcaggagttcgagaccagcctggccaacatggcgaaaaccccatctctactaaaaatacaaaaattagctgggcgccgaggtgcacgcctgtaatcccagctgccgggagactaagacaagagaatcacgtgaacccaggaggcagaggttgcagtgagccgagactgagccattgtactcgagcctgggagacagagcgagactctgtctcacaaacaaacgaacgaacaaaaccaagaggggacttagatggatgccacagtgttgtctgagatggagcccacttgtggtggtcttggtagtcccctgggcatatcccaaaggcctgggctcctctgctgtggcagcatggcgggagctggactctgtacgttgactcaaaggtctctatgtttgggctagtctggaagtgtctgagaactgggggcttttactcaaaatgacattggttgattgctacataggtggttgatcttccagttgctgacaggtggaacctgaggcagcaggacagcctggcattggccacgggacatcggccacaaccatagcaacttcggcatcaaatggggcaggagagagaacattaaggtatcgttcaaagaatactagaggtcttggatacttctgtatgcctgttctttatcttgtcctaaaagatcttccgagggtccctttagggcaaaaccagaaccttctgtgttgttataaaggcagggtgggtgtgccattctgggcatttaaagtgcagactctagacttgtatgcatgcgtagcctcctaggttaacatttaaaataggctctgggaaacctagtttggtgatagggagactggggacactgatggtgacctggtcctaggatgggatgaaggtagcgaggatgggaagctagaggaggctaacctttggggtgtcttgatggcttctgaaaagggcctctctggcccccagtactaatacttgttataccatgaacttaagctgctcttgatgggaggggaaagagaagattattgttaacaaacactattgcagacagtgcacatgctgtcacatttggtcttcacaacaaccctgcagggtggggatttatttctgttttgcagattgaagaaactgaggctcaaagaagttaggggtccacctgtgagtacatgcacaggaaggggaagagcccccattggaagcagagccctgccccttcctcctcacccctggctccctgggaggcccctcctctggcccagtccacagcactgtgacaggcagtgtggaagcctctttcccccagtactcccctcagagcccttccttccttctgagctgggaaggccaggttgtagttagccaggccaatccattggggttctgaattagccactttcagctgtgtgttctttgacatttctgagctgctccaggcctcagttttgtcacctgccacttgtggagggggaatggggaagggaaccaatagatacatagcccacacgggggtctctgggtgatgactagccctgggtgctgggcagccctctggtgagacaggcacagtgggatgctcattgctcatggcttctcagtgggtcttggtgggggtctgaggacctcattccacctgtctcctcaggggccagaggctgctggcctggctgtttatggcccccctccctgggagggtggtggggtttggccagaggctgtgtggatgtccagatggggcctccctggggtcttggacctgcaactgagtggttgtctccctgccaggggctggcagtgaccacagctgtcccagtcaggaggaacacctcctgccctcctcattcttgcagcctcaggagctgctaagaagcatgttgggcaggtggagatccactcagtgacttgttccatggcatgtcatgagcacgattggcagggccaggccagatcagtaaaaagggtgagagctgcgaggcataggcctgctcagtgctcgaaggggagaggagctcagctgccccacaggtgtgtgcccttgggggtcactgagcctctctgagcttatggaattctcctgtctgtagaatggagataatgactgtctcaagaggttgcttgcacagttatatgagacaatgtatgcaaaggatgtggcacgtgtctggcccttggcgagtgatcaggccctggcagctgttattatcatcgctgttacgggctttattgccctcctttgtttgtatgtccatcttagagctcattgagggcagggtctgggtcagatttctctcttggctactcctcctcttcctgatcctcccagggacaagtctggcttcagccccgtgaagcagctgggatgggacatccttaccaggccggggctgtgttcagagctgcacagtcctgtacggtagccattagcctcatgtggccagttagattcaaataaaacttaaacattcagtgtctcagttgcagtagccccctgctgagtgcttggtacccacatgccattggtgcctacctattggacagcacagggtagaatctttccatcatcgcaggaagttgtgcagagctggagtctcagggactacagcaccagtatcatcctcactgtggctcagcagccaccagccatctcctgagtgctgggctgccaggacatttgtaattacacagaaaccgagtcccacagcccttcccgaatttcctctcgggtagccttgctcacctggtcggggaggttgttgcctggaagtctttatcagcctaggctgggagggcagggctgggattgcccaaatgcagctgctgcctcctgtccccaccctgtttctcccacctctcctgcctggcaaggagtcccagagtgatctccctaattcactgctgtggccagggccgaggtggcccagacactttgaccccactgctcccctcatatgctctggacacatggcctctttcctcctgcccactccgctctccacctgaacaccttcttgcttctctcactccaggcctgacttacgtggctggtcctccaggaagccttttctcatctctcaccctccgtgagctctcctgccttggtggtgccctccctcagaccccatttttggcactcagtgccctcctctgtgggtgtgttcttgtatttgcttgttctcttggtcaggcacacagcagataatcctctgagtgccgacgacacatcaggtcagtgctgggtgttggacagccagaggggagcaggccacaggccaggctttgccaacttcaggcctgtggggaggctgacagttggccaaactgttccatgcaggcccaatgctcagtcagggatgaaggctgcctggctggagggtcgggaaaggggccccaggaagagatgcagaagtggaaagggccagaactggctctaggctgcagctgccaggtccagggtggtctttatggctgggggaagtgacagcgatggtacggagggtgggggacaatgaggatgcaggtacactgggcaagaggggattaaatgtcaggcaggataggtctgattgatggtactgggtgggcatcttatctcactgctgcaccgtccccaggggtacagaaaggtctgaatgaatcccatgttccctagccctacagctgggcacgcagtaggggctcaggagatgctgtggaatcaatgaccagatgctgaatgagtccctcatggaaaaagctgatgcatggggcctctccttgcccctggagctagaggtaggagtcagggaaccccagagacatgccagctcagcaaggctaggccaaggaggatgggggtggttgtggaagcccagggtgattctcagtgtcctctggtcattgctccctcgtcctgtgaactttctctgagctcccactctgtaccaaggagaccctgtccacagtgagttggatactgccagtcccaggaggaagtagcccagtattggcctgtccagctgtgcccgttaagaggccatagtgcttccgtgctggttgaccaagagctgttatcccacagccccaccccctagggctgcagtttcacccccaaagccccagcagatttggctctctcccttcccctcccacacaaaccagccagtaaagagttgagagctgatagagtggcggcctccaggaccccaccctagggcagattctaactgcttgagactgatgatgagataatttgcagtgtcatccttgtgtctaatgtgagatgaccttgatttgaagtgtctggtgtcttgtcactcactgccttgcatatggttctgaccagtcaggcaggctgggactgaaggtggctccctggtgaacctagcactgtgggagttcatagtagaatcggcttaggtgctgccacccaactcaactccactccctccctttctctcttctgcaggcagccatgagctccagccgccccgagccgggtccctgggcacccctgagcccccgccttcagcccctgtcccagagctcttccagcctgctgggtgaaggccgggaacagaggccagagctccgcaagactgccagcagcaccgtgtggcaggcccagctgggcgaggccagcaccagaccccaggccccggaggaagaggggaacccgcctgagagcatgaagccagcacgggcctctggccccaaggcgcgacccagtgctggaggccactggtggagcagcactgtgggcaatgtgtccaccatgggcggcagtgacctgtgtcgcctgcgggcccctagtgctgctgctatgcagaggagccattcagacctggtccgtagcacccagatgcggggacacagtggtgctcggaaggccagtctcagctgctcagcccttggcagcagccctgtccacagggctcagctgcagccaggtggtacttctggccagggtggccaggcccctgcaggcctggaaagggacctggctcctgaggatgagacttctaactcagcctggatgctgggggcgagtcagttgtcagtgccaccactagacctgggggacacaactgcccacagcagcagtgcccaggctgagcccaaagctgctgaacagctggctaccaccacctgccatgctctgcccccagctgctctactctgtggcatgagggaggtgagggctggtggctgctgccatgccctacctgccacagggatcctggcctttcccaaactagtggcgtcagtgagcgagtctgggctgcaggctcagcatggggtgaagatccactgtaggttgtctggggggctccctgggcattcccattgctgtgcccacctttggggtcccgctgggttagtcccagagcctggctctaggaccaaagatgtgtggaccatgacctcagccaatgacttggcccctgcagaggcatccccgctgtcagcccaggatgctggtgtgcaggcggccccagtggcggcctgcaaggctgtggccaccagtccgtccctggaagcgcctgcagccctgcatgtgttcccagaggtaactctggggtccagcctggaggaggtgccgtcccctgtgcgggatgtgcgatgggatgctgagggcatgacatgggaggtgtacggagctgcggtggacctggaggtgctcggtgtggccatccagaagcacctggagatgcagtttgagcagctgcagcgggcgcccgccagcgaggacagcctgtctgtggagggccggagggggccactgcgggctgtcatgcagtccctgcggcgccccagctgctgcggctgctccggcgcggcccccgagtgaggagctgtggcccttggagctggcctgggcccactgacttagtcctagacctgggccagggacggtgggggctccgtgccccctggacccaccggcagctgggcacatctctcacctgaatattggctgcctccagaccacaggactgcagcctggggcttccggccctacacagctgggctgttttcttaagggcttgatttccaagggccacatctctgcaccttccgggctctgaactttgagacagggctttagcactgtgcagaggggagatcctgagttttctgtaaaaaatgaccttttgttcactccaccctcagaactctgccatgttgcctcgtcagactcttggtggctttatttgaaatcagtgctgagaaatagtgaattctcgacatgaaatgtgaggccccagtgacagggactgcccaggtctttagggaaggggactgatgttatcagaggcctcctgtgtgccacatactgtgcttgtcctgtcttcacctcttcatcctggcaagccttcatttggcaaggctgtagccgatgtgccccacgctggacagcttgaagaggtgggactgagatccaaagccagggccagctgagccgtgggtgttgccctgtagcatgtgcccggtccagtcagtgcagtcatgtatgaggagaatttactgagctcatactctgtgctgggttctgtggattctgtggtgaatgagacagaggctgcccctgccctggctgagctcatggtgtgggttggggatggcaggggaggatgctgaccattacggagggctgccaggcttccagggtcattgtgtcagaggctggcctgaggaaggggagaatgggtggccacctgccctaatctcagttacaaagcctaaaattgcactattttcacctcattctgtcggctgaaggatttctccccagctggtgcagtttgtggaaggagggagggcaggaatggagggggacagggcaggagtttgccctggccctggggtaggggctgtgaggctgtgggggctcgcttgcccacatgacctgacctaggctaggcagtgggggccaggggccttggagagacagaaacatgggctttggcacagtctgacttcattgcccaaagatttctcgaggcctgtgaagaatgggagtgggcttgtgttcttgtcctgggtctttgtcttgaagatcctaagatcccgtgacacagccccccaatccacccgtgtgagggaccagagggctagtgtggggtcatggcccacgacctggcctgtttctggagcctcttctgcacctaggagcccaggacccccacagtggtggcttacttttccccatcctcaaggacctggtactcattgaggtggaaatgactcatgcaacagttggtgaatttgtaaagcaggagtggcatttcaacaggccacaaggacaaagtgacaaaggcgtgcgtcaggtcagatgcctcctgaagcccaacgatggaccattctcacccgtaaacatgcctttcccatatgcataggtgcaccccttgggattctggggctgtcagtccctttgtgtatggtgccagggcaggcagctcacgttctggggagtgacacatgggtatatgccatcttcatgcctggctccccatggagtctccaggaaccccagcctgttagggccacatgagagagaacaaatggctgtgggtgcatggggagggacctttcacacagggccatagctaagtagggtcttgaggatgcaggggttagacaggtgggtggagagagggcaggacctgcctggcagatggaacagcctggtcagatacttggatgtgcctgtcctgcctgggccataatgagtttctgcagtggcggctcatttggagcgtttgttgggttgggaggtgaccaggggtccccattgtgaagatcctgatgtaaatgaggaaaggaactttaagggaactgtggaaggggttctgaggtgggaccagatttcagtttagaaatatccatttggcttccagtggagatgtgccaggtgacaccaaggaggggcctgtttaggggcaatggagtgggcagctgggggctgggttcatacacgtgcacacacacgcatacacaggcacacatgtgtgcaatggatttggggaggaggcatttcaggatgctgaggtttccagtttgagcaagaggagggtgaggccactacctgggtcaaggtgaatggcatgttcagcaggtgcagaaagggccacctgccacagggtttggctgggaccagtgaaacctacttcatgaagagactttcttctgtgtcacgtgcagattcttatgcattcacgctggctgggtgccactctgtgctacctccatgctgccctggcttgccaggatggcaggccgggctgggctcagccaagctcccactcacctcatcgtcactgagatgagtatttgcagagcggtgctgaaatccaacacctgtgtcttggctggggccccagatgattctcctggctaaaccacgatccttgtctccctagcccagttgcacagctgctgctgacaggtctacctgaagtgactgcagcctcatttctgattggaactggagacccctcccaaccccctttgctgtgccctctcctggaacagccctgatgcctgcagtggtttagggccccagagcatggccagcggtttagtttacagatctcctccccttggactctagatttctggccagactttctgggtccctttcaggccctgctctgggaggtgttggagttcactgttgatgtgtttgtttggctttgaattcaaaacagatacaaatttggaggtgagagctttgccagaccccagcagggatggggcatcggtcctgactggtcttgtttattttgtcctggtaaattctgttctttggagcataaaccctggagtcctagagccccttgcctcagcaggaatcccccctctgtctgctccaggggctccctgcttctgcccacctgctctccttccatggcattcaggacccccgacagctgaagcctctcttcatatagcttgtcccctctgggcctgcctgtcttgtgtccaggacacaagacacgcatcccttgtctggccccaggctgccatcactgtcacaagaaactcatagagtagagctggtctgaggtcacagtgctggtggtggtggaaaagcagggatggcctgttccactgtgatcttacctcctgtgtcacctggattgggtctctgtccccttagacatgctagatcctaactttacaagggctgaaggggtcttctacacgcaggtcccaacactttgggctggggttggccaccgtagcttagtgggctaaagctggagtttgaatctggatatataggatccacacctatagccatgtgatcttgggcaagttacaagccttgatcatcttcctcatctgtaagatggggatgacaatggtgcctccttcacatgcttggtgtggagattaaatagaataacccaagtagtgcctggcactgagttagtgctcagcacacaggctggtagtgttgggcacccctctcatagccacattcaggggccacctcttaccctgccagcttggctgtgatcacagcccacatcccacttccttaaaagtcccttgttcagagcctctttccaggttcctcgccccacagctttgcaccctgcctgggacttggccctctggctggggcttctgaaaatgtagttcccagagtgcattgaggagggctaccctagccctcaccactcatcttgggctgggttccccagaagcttctgctgagatgaggatgctggagttattagggaggggagagcaagttaagggaggggcagaaggcaaggcagggtgtgatttcagtccaagtcagaccctaaaggggagccctggatgcagtcccacctcagagtaaggactacccaggggtgaagatgtagcctccaggcacttctgctctctggcaggcaggctaggaagctctaggagccccagggtaggtttctgctggagtcgtagggcctattttgggggaagttgtgcacagaaaccaccagagggagtcacaggcatctgggggtgcacccattgacatttgcatccatgtcatgccaagcttgtagcccacaaatgcccaacccttttctccatgcattgctctgtctcagttttgttcacgccaagcagccttggttagttaaatgcagagcttggcatttgcccatgttaaattccttctcctttttcattctggcctggcctggttttgccatctgaagctatgacaagtcctttatcagttttcatccaacttgtcaggcagggcagggctggtatgaagcccaggacatatcactgggacatcccataggtctgtgagattcccaggtccctccaaatccacacggtcatcatgggcaaattagtttaagtctgatctgttaagatccagatctctcacaccaacagcacacacccctttttcccatggccatggaaggagggtagcatagcctgactcgagtcctcgttctcagcagaactggttctgtggtggccacttccctttctcaacttttacctacttctgtttaataggttgttctgcaagtctgagagcaacagcaagcttagaagtgtggactcagcctggtacagtggctcatgcctgtaatcccagcactttgggaggctgaggtgggctgactgcttgagctcaggagttcgaaaccagcttgggcagcatggagaaatcccatctctacaaaaaatacaaaaattagctgggcatggtggtgtgcatctgtagcctcagctactcagggggttgaggtgggaagatggcttgagcccaggaggtggaggttgcagtgagccgagatagtgccactgtgctccagcctggatgacggagccagaccctgtttcaaaaaaagaaaaagacaagaaagaagtatggactctaccttcttgcccttgtggagattgggaactgcctgcccttggcctctttcctgtccatcttgtattatgaaaggctgtttctggcacacccgggctcctctgtgtggtttctgggaagtgactgagggtcaggggaatggagcccctctgcagccggccgctggtaccttccctattgaacccttctttaggtttgctcactctttttgatgggtgtctttccaaagctggctggggacctccctgattgagagacatggggccagttctgttgctgtggctacacgggaataataaagcagaagaacacctgaggaaagctgatgtttactaaaaaaaaaaacaagcgaaaccaaagtgacgtgggcccataggattggggatgggtggtggggtctgactgccttgtcccaagagttgggtgaatgccgcctttgctcacttgtgcggtcactctccaggactcctgcctggcttctcccactccaagcccgagatagcccagcaaggaggaaggtctggccccaaaatacgagctccccaagtggatatcctaaaattcatctttcatggccctactttattgggagggaatgtgaaaattgtgggaatatgtccattgacatctggggctcagggcaggggagtgtgtctagttttaaggtgtgcgcttttagccatgcagtcatcgcccagtctgtcctgcctggagcttttcatttccctgcagctttcctgagaaaagacagagtgtgctttctctgcatcctatgaacatggccccaggactgcagcacctctgtgtgcacacagccaaggacagtcgggggacctctgctggtcctgcacccgctgccctgggtgctctgtcatccccatcccccatttctctttaatctgttcttcttttgtggtttcatgttctctttgttctgggttattcagaacctgtctgcctccccactgtccattgtacttgttcctgcctcctcctgctttgtgccaaggatttacttgccttcgccttctggctccatacagtagtctctcttcttgcggtcttggccattccccccaccaggcccccagctgtggctgtgtctgggtcttggcatttgtgatttacatgggtctaggccctttctctccacctgtccttcccctctttggacacaaaccaaaacatctgagcatctccttacagagggaggtctccctggggttgctgtgccaagtttccattgcttttgcccagaatgagaaatcagttgtcagtggccctgctgggtgaatggaaggactttggtcgggctggaagggcaccccatcagtcctaacttttggtggcccttgttggtggctggctggctaggctgctagagaggtacatcaggtgggtggcacccatctgctggctttaggcaggccatctcctcatccatgttttcagaatcttcttgcatggcttgtaattgggttggggtgtggcctgagcccctgtggggacacactgcactgtcccacctgtatgcttctctgctgtcaggaactggattcgtgtccaagagccaaggctagggactggaggaggagatttctgtctttgacccctccatattagtccattttcatgctgctataaagaactgcctgagactgggtaatttataaaggaaagaggtttaattgactcacagttccacgtggcccggggagcctcaggaaacttacaggaagcctcaggaaacttacaatcatggcagacagcgaaggagaagcaaggcaccttcttcacaaggcagcaggaaggagaatgaatgcagaaggaactaccaaacacttataaaaccatcagatctcgtgagaacttactatcacaagaacagcatgggggaaccgcccccacgattccatcacctccacctgatctctcccttgtcacatggggattatagggattacaattcaagatgagattttgggtggggacacagccaaagcatatcaccctcccaggcctgagcaaggcccaagcagggagcctctgttggggctggaaccctgggaggggtagaattctcccctccactcagatttgttccctgttgctgcccacctggcccctgccctgcagccttctgcctggccttctctctgttcacttctcatttttagcagtcaacagactgggagatggtggccaagggtgtcattttgtacacaagctttgtggcttttgtaagcccagcctgcaactcttgaggaaaactctttggtttgattttttttctcttcagagttgggggtattcagggagaggggcaagggcttcttgtgaagatttcaattcttgaaggtgtggaagcctcctgggctgggggaaggggtggggcaggaaccagcaggggtgtggacacaggggtctggcacctgggataccgtaggacagctgggcaggaagtcggatgctgctttattgaaatttttgatattttatcattttttcattagtttttattttaaaacactgctttaaaataattaaaatatgatttatcttggttaccgaatcacttagtgttgccttaaattttgcgcctagtccctgcctgacctttcctcctcctctcccagggctttaggtactcttagtccctgtgtcatagggactgggagcagataggcccctccgcccaccccacccctcccccacccctcgcccacccctcccccacccctccgcgttcctactctaatctcctaccctgatctgcggtgcagggcggcgctggagagggtggcttgcggctgatcccgcggtctggtttgcggctaggtgtgtgtccccggactggcgtgggtcccgggccaggcgtggtcctgggcggcgcggcccgtgacaggacccgacgcctcctggtgggcatttcgctccaagccgggaccctcggagcctgaggggattcgggagggaggagtcgccgtggggcggggcggggcggggcgggggagggctcccaaggccccgaggacagtcccaccctcaccgacaggaccgtccctgcgcatcccccacccttcttcatcttcgggcgctcgggccaacctggacagcagggcggaagcttccagaaaggacagagatggagaaggtgggaagggtggggctcaggcaggggacaccacggccttaggaatggaagacaggccccacttacctcttcgactccagatgcagctcatcctcacgaggggctggatgaagagggcttcctctctttcccccctaagctgtgcctctgagcctctgtgcaaatatggtggtgcaaacctttggtctgccttcatcattttgttgttgttgttgttgttgagacggagtcttgcaggctggagtgcaagtggcacaatctcgctcactgcaatctcagcctctgggttcaagcgattctcctgcctcagcctcagcctcccgagtagctaggactacaggtgcgcaccaccaggcctggctaatttttgtatttttagtagagatggagtttaaccatgttggccaggcagctcttgaactcctggcctcaagtgatccaccctaataaacttgctttcactttactctgttggctggctcttgaattccttcctgggtgaagccaagaaccgacgtagcctcccaggctgaacctcagtttggggctttaccccatgacacccgcaaagggctgggcttcccttcttcttggggagagggtcaaggaagtggctgtatcttgaacacccattcctctttccttccatgcgcacaaggcctctctgagctgctgtcttccttaggacactttcagctacaagtaagttaattttgaactgaaagttagctaaacaattattatagaatgttcaccttcccactgaagaatttaggaggtaactggcttctgggtgggctgtgtggctcagtgtggacatggattcaggttctttccatatttgtgctgtgccatctttagagcgtagtgaaggctgtccttagccccacgatggctgctgcatttcaactctggaattcagttgctggaattcacactccagtctgtgtgactccagggcggtcattttgtttgtcttttcaaaaatgaaagtaatacgtacttatgataagaatttaaaacagtacagacctcggccttttgttttattcatgataggaatttcaaatactgtgtaaactgaaggtctgatcctcgcccttgtctggaattcccgcagattaccactgaagatgttaataatttccatgggccttccacaaacttccttggtaatcacaagctcagacctctgaatattccatacaagtgagatcccacttagatactattctgtattaattctttaagataggccaggcatggtggctcatgcgtgtaattccagcactttgggaggctgaggtgggaggatcacctgaggtcaagagttccagactagccaggccaacatggtgaaatcctgtcgctactaaagatacaaaaattagctgggcgtggtggcgggtgcctgtaatcccagctacagtcaggagaatcgcttgaacccaggaggtggtggttgcaatgagctgagattgtgccgctgcactccagcctgggcaacagagcgagactctgccaaaaaaagaaaaaaaaaattaagatatgtcttgtagataatactgccacatataacaatattttctttattttcttcctgggcatattgtatggcatagtatacaagtgccttttaaaattaaaccagacttctttttctggactttatgttacacctcacattttttttaacttaatagatttatttcttagatgagatttaattaagagaaaaagtatgcagaaaatacagagttcccctacactttctcactctcatacactttctcctattatgagcttgcatagtgtacaacatggtacatttgttacaattaatgcaccaatattgatgcattactgtttcctaaagttcatggtttaaagtttactctttgtgttggacacttctctggattttgaaaatccatgtggtgtatctcccactccagtagcatacagaatagttggaccacctaaaaatcccctgtgctccgtccattcacccctcttaccttccccaggactcctggcaaccactgatctttttactgtctctatagttttcctgaatgtcacagagttggcttcatgtagcatgtagccttttcagacaggcttctttcacctagcaatatggatttaagcttcctccatgtattttcatagcttgagaactcatttctttttagtgctgaaaaatgttctgttgtctgggcatactgccatttattcatctaccaaagggcatcttggttgctttcaggttttgactattatgaataaaactactataaatattcatgtgcaggttttgatgtggacatatgtttacttcagttggttaaatacgcagggcaacattgctgtaagactatgtttagcttcataagaaactgccaaactatctctgtacaatttcgtattcctactagcaatgaatgagagttcctttttctcatataaaaataaatatccttgtatgtatagttttatgttcaggtgtgagtatatctgtaggataaatttttcatcaagtggtacatgtaaaatatctaccggtattggcaaattgctccccagaaagattgcaccaataatacatgaaaacgcatattttctcatacccacgccaatatttgattgttaatcgaactttaatattttggctaatttgataagtgaaggaacaatgtcttcctagttattgtgatttgcaatctgttccctgtgagtgaggttgtggtctgccggactgcgtgagtgagaattcctgttctggcactctcaagctgtgtgatgctgggaaagttgctgaacctccctggacctcagtttcttcatctatagaatgaggatggtaatgggtctttaccttattaattggattggaggatttaatggcatcattcatgtaaagtgccagcacagttcctggctcaaaataagggccaagtaaatgtaagctattattattctccaatatgttcataagcacttgaatttcttcatttctgatctgcctatgttcatatcaatttcccaggattttttcttattgattggttagagctctttgtatattaataacatacgtttatttttttcatataagttacaagtatttttttattccagtgtttcatttgtctcctgtttatcagatcctggctccaaaccagtgcaacatccttctcagggacacagcattttaaatcttacaaagcccctcatttcccatctgtcatttatgtctcaggacatccacatgaggcaagctgatgtatttttcagtaaagaaggagactttattgaccaggcagggcgagtgacttgcctaagggcacagaaggaattagtggtttgtacagactgaaatggagggtcctggcccctaggtaccacctcctccactcttaaagaaggggagagggaatctggaggtgcaggaaggaaaaggtcaaggtcatcatgacagacagcctcaccccatcccctctcagaacccaagagcctgggtccttttttttctgttaagttctgaccattctctcctgataaatcaagggaagaatgcgagtaaagggtatgtgttactcgggcgagactccctgcttggaaggtctaggaggggaggtatgtgtgtgagtgtgtgtgtgtgtgtgtgtgtgtgtgtgtgcattctttctgtcaagttgcccagcaggtgagctgaaagctggctctcttaacttggggatgagcaatagagtcaggtctcggttcgtcattttccaatttcatcagctttgaaaatattttaataataaaatccaagcatttgattttcctgactagttgtttattctgatttattggctatgcatggtgcctgaagctcctccaaactcccaagggtatccctgcatgtctcaggatgtctcttaacccagtgccatgtgagggacagaacctagaccaggcattcagagccaggtaccattgtgcctaccctactcactgctagatgatgctagtgaggtgctcacacctctctgggcttagtccctccattgtaaggcaaatgggaggcctgctgcctctgccttgctgggttgttggtatggctgaaatgaggggatgaaggtgatgtggaaaacttgataggagagtggctgccgtgtgtccattctggtctcctttgtctcatgtcaagcccagggactggttctttttctctcttcgggtctgtgacttctgggaatcctgcttgcctcggtgccccctggtgaggtggtgccatataggttgctttagcacatcaccgagagggactctccaaaccctatgctaagtgttcaccgccagaacacttgcatttgggccagaccgggctagggtacctaaccatagcttcctgggttcatttcacagggtggacagcaactgagagatgtccagggaaatttccctttttaagagataggggttctggggcccataagggcaggaagtatccccaaccacaggcaagttcatgaagcccatagggagtaggatggagccagttgccaggagcagggaaaggttcatgtctttgctcctccatgtacccagggactcagcaccacctgcaagttgatggaaaggcagaatctcagcacactctgagcccccgaatcagagtctgcattttaacagaacccctaggtgaggcagaagcccactactccagtatcattcattcattcactcacctagcaaacatgcctgaggccgactctgtgccgtgccctgtgctgacgaagaccggccaaaagaccttgttctggtcttcctgaagctcaggtggagcagacaccccaacggccaacaaatgtgaagattgagaactgtgatgggagcctgaggtgggagcagctaagcttccctggggaattgggggtcagggaagtagtcccaagaggctgagtacctcctgtgtggcaggggcagggtggcctttgctccctagtatcttttttttttttgagatggagtctcactctgttgcccaggctggagtgtagtggcgctaccttggctcactgcaacctccgcctcccaggttcaagtgattattctgcctcagcctcccaagtagctgagattacaggtgcccgccaccatgcgtggctaatttttgtatttttgctagagacggagtttcgccacattggccaggctggtcttgaactcctaacctcaggtgatccacccaccttgtcctcccaaagtgttgggattacaggcttgagtgactgcgcccggcctgtgctccagtatcaaaacctgcaagcacctacagagtggagggtgctatggtcagggtggtgctcaggtccagactgatggaggaacctgagcaggggcggggaggcatttcaggaagagggagcagttgctcctgcacaattttgttgcatcgggccaagcaggaaggctggagaggtgaggaagagccccgggggaaagcatggaccatcagggaaaagtcagacattgccctgttgctaaaggcactcctggatgggttttagcccggggagacctgaatcaaattagggtgcatagaaagaccatgatatccccttgatggggaggagaaagaggagaaacaggaggactaggagggaaagccgaggcgatttgactcagcatgagtgagatgtggggcagggagagagagagagagaaagacacaaagagagagacaaggagagacaaaggggagagagagaggagagagagagagagaacagagagacagaggagagaaagagacagaggagagagagaggggaacagaagaaagagaggcagagagacagtgaagagagagaaagagagagagattgagaaagaaactttgcatccgcaggcctgggccccatgcagcactgacagtggtaggcagccgacgtgaagcaggaggcacaggcagggaggatggacacagcacctcccacagcttctgagtccttggtgcagaatgtttatggcacttttcttcgttctttcttaagacttatttagtactcatcttttctcctttactccattgtgagcttcccaatgataggggcactgtctctctcatgtctgtcttcccacattgcttatatctaggatgggaaatgcaaggctcccaggcaatgcttagttaaaggggcaaagggctgtggtcttgtcttaagtctctgccaggctgaatgcctagaacttggccctcaggagggcctgagtcactgtgggacacagacttttaaaaggtgaaacagccaccagccaggggtgaggaactaacagcagacacattgcctgattttaagatgtactataaagctacagtaatcaactaagtgtggtattggtaaagaatagacatagatcaatggaacagaatagaaaattcggaagcagatccacacatgcacagccaattgattttcaacaaagatgcaaaagcaattcaatgaagataatcttgctaacaaatggtgctagaaaaatagaatacccatatgcaaacaacttatttatttatttatttatttatttatttattttgaggcatgtcttgttctgttgcccagactggagtgcagtggcgcaatctctgctcactgcaacctccgcctcccaggttcaagcaattctcctgcctcagcctcccaagtagctgggattataggcgtgcaccaccacgcctggctaatttttgtacttttagtagagacaggattacaccatgttggccaggctggtctcaaactcttgacctcaagtgatccgcccaccttggcctcccaaagcgctgagattacaggcatgagctaccacgcccagcctatttatttgttttctttgtataaatttagggggtccaagtgcacttttggtacatggatgtattgcatagtgtgaagtcttggcttttagggtggccatgacccgaacagagtgcactgaaccctgtaagtaacttctcatccctcgccctgctcccaccctgctgcccttctgagtctccactgtctattatgccatgccgtatgtccatgtacacacattatttagctctcacttgtaagtgaggacaagcagtatttgactttctgcttctgagttattgccttaaggtaatggcctccagttccatccatgttggtgcaaaagccattatttcattctttcttatggctgaatagtattccacggtgtatgtgtacacacacacacacacatctataaaatatattttctttacttaatcatctgtcatatacaaaaaagatttatcttgattcatacttcgcagcatatataaaaatgaacccaaaatggatcacaggcctaaatgtaaaattgaaaactaacagatacaaacaaagaagaaaatgtgtgaccagggttgggcaaatatctcttagatgtgacacaaaagcatggcctacaagagaaaagtgaataaactggctatctttttttttttaattattattatactttaagttctagggtacatgagcacaatgtgcaggttagttacatatgtatacatgtgccatgttgatgtgctgcacccattaactcgtcatttacattagatatatctcctaatgctatccctcccctacctcatcccacaacaggccctggtgtgtgacgtcccccttcctgtgtccaagtgttctcattgttcagttcccacctacgagtgagaacatgcgatgtttggttttttgtccttgcgattgtttgctgagaatgatggtttccagcttcatccatgtccctacaaaggacatgaactcatcattttttatggctgcatagcattccatggtgtatatgtgccacattttcttaatccagtctatcattgttggacatttgggttggttccaagtctttgctattgtgagtagtgccgcagtaaacatacgtgtgcatgtgtctttatagcagcatgatttctaattctttgggtatatagccagtaatgggatggctgggtcaaatggtaattctagttctagatccctgaggaatcgccacactgtcttccacaatggttgaaccagtttacagtcccaccaacagtgtaaaagtgttcctatttctccacaacctctccagcacctgttgtttcctgactttttaatgatcgccattctaactggtgtggtggttttgatttgcatttctctgatggccagtgatgatgagcattttttcatgtgtctgttggctgcataaatgtctttttttgagaagtgtctgttcatatcctttgcccactttttgatggggttgtttttttcttgtaaatttgtttgagttctttatagattctggatattagccctttgtcagatgagtagattgcaaaaattttctcccattctgtaggtttaaactggctgtctttaaaattagaaacttctaagctgggcacagtggcttacgcctgtaattccagcacttggggaggccaaggcaggaggattgcttgagcccaggagtttgagaccagcctaggcaacatagagagaccctatccttataaaaataaaaaataaaaaaattaaccttgtgtggtggcatgtgcttgcagtcctagcaacgtaggtggctgaggcaggaggctgaggtgggaggatcacttgagtccaagaggtcaaggctgcagtgagccatgattgtgccactgtactccagcctgggcaactgaccaagaccctgtctgaaaaacaaaatccaaaacttctactatttgaaagacacagttaaggaaatgaaaagacaaaccatagagtggaagaaaatattttcaaaacacatatctgataaataacttgtattaaggatatatgaagatctctcaaaacttaacaataagaaaacaagcaacccaatttaaaaatgggaaaatatttgaacagatgcttcatcaaaggaggtatatgactggccaatagttatgtgaaaaaatgcccaacatgcttagttatcagggaaatgcaaattaaaaccataagatcagaccaatgcatacaaaatggagtggcttaaaaaaaccctaacagtaccaactgccttgagggttctcagtaccaactaagaactcttgtacactgctggtaggaatacaagatgggatcaccactttgtcaaactctgtggaagcttcttataaagtcaaacaaatatttaccacatgacttaccaaacatactgctaggtacttacccaagagaagtgaaaaattatgtttgcacacaagcctatccaccaatgtttacagtagctttatttattatcaccgaaacctgtaaacaaccccaaagcccttgaacaaactctggtatatttatgtaatagaatgcttatcaataaaaaacaatgaactaattatatatatatatatatatatatatatatatatatatatatatatgatggataaatctcaaatgcattctgctacgtgaaagaagccagactcaacagctgcgtatctgaattattccatctgtgtgaattctggaaaagggaaaactattgggataggaaataaaggagagcttgccaagggctggagagtaagggaaaggctgactacaaagaggctcagatggatttggggagtgaaagtgtcctatatttttactgtgatggtaacatggttgcgtttgtcaaaactcatagaattgtacactaaaaagagtaaattttatcatacacttatatcttaatatacttttcagaaagcaaagtatgtaattatacagatcaacaggaagaacaaataaaaccatacaatactcacacctgcaacataactagaagacacagaacactataatcttccaattacccaagagaataaaaataagcaaccattaccagtggagctctttctgaagtttctgccccaaaccttgtcaccgagtaaggcagagcctggataaaactgcatgggaggtgcatggatcacctgaggtcaggagttggagactagcctcgacaacatggagaaaccccgtctctgctaaaaatacaaaaaatagtcaggcgtcgtagcgcccgcctataatcccagctactagggtggctgaggcaggaggattgcttgaaccccaggggctgaggtttcagtgagctgagatggcgtcactgcactccagtctgggcgacagagcgagactctgtttcaaaaaacaaaacaaaacaaaacaaaaaaacaacaacaaagagaaaaactgcataggagagagaacaggggaatagagtgctcaagactgagctaaaaccatccccagaaagactggaaacagcctagttgtccttcaatagctggatagttaaaggttagaccagcatggtacatccatgccccaaaatgctgctcagtagtcaaaaggaaggaactgttgtctcagaatgcggatggatctccaggtcattctgctgagtgaaaacagacaatctcagaaagctatctttgtgtgattccattgatgtaacactcttgaaacaaaattttagaaatggagagcacattagtggttgccaggggttaagcagatgtggctgtaaaagcgctgcgggagggatcccgcggtgacggagcactctgtatcctgactgtatccatgtcaacaccctggttgtgatgtggtcatacagtgttgcaagatgttacactggggaaaactgggtacagggtacagtgggcctctctgtatcattgcttacaactgcttgtgaatcatgactctacagttaaaaagctcggtgaaaaaaaaaaccctcatttacaatcgcatcaaaaaatgtgaaatacttggagataaatctgacaaatatgtgtaggacttgtagactgaaaactacaaaacattggtgagaatgaaaggcttaaatcacagtacgctaacaatagatggatttgatgaatgtaagtgaagggaaatagtgttgatcacagacctgaaatttttctttttcctttttttgagacagtcttgttctgtcacccagtgtgtagtgcaatggtgtgatcacagctcactgcaacctctgctccccgggttcaacaaattttcctgcctcagcctcctgagtagctgggattacaggcgcccaccaccacgcccagataatttttgtatttttagtagagacgggagtatcaccatgttggccaggctggtctggagctcctgacttcaaatgattcgcccacctcggtctcccaaagtgctgggattataggcatgagccaccatgtccggcctgaaatttttcaaaataaaatgctggtaagagggaaaaaacaaaaaaagcataggaagaagattttaggaatgcatagttagttctgctataacacaatatatgtgttcctaaaaaaccagtgctctatgcaaaaatcacataataaaaaccactgggcttatgggaaaagtggggttaaccgcacaacactccaaaattttgtcagtagcccataagaaacaaaaagataggaacttaataaaaatagtcattgagttttgcacgtttgatggttaagaaaagcatgtatattgcaataaatatgacacttgatcttgaaaaagccctggagtttgtgtgtggacgtgtgtgttaccagacatggagctgtaacaccagatgtggatggatgcagctcataacacacgaggtggatgcggagctgtgggcatttgaggcatccatctgggtgtattttggctcggttcagttgggtacaactttctgtgctcacctagagtttcttgtagaccacattgcacataagcaagtgtgaaattcacatcatgctcaaattgttccctaatactgtaactcaatctcatgggaacaaatttctgttttcaaaacaagtattaacagaatggactgtgcttgttaaagtcacaggtggcaatcatcaacaacttgttagacagtttgctctttaaatgcatagatttctaaatctaaaaattaggaaaaaaaaaaaaatgaaacctcatgcccaggtgtgaccatttcttgattgcatcctcacaggattttgggttgaaagaaaacaaagtccctgattctgccacagcccacccaagcatgtcctcagaggtggcattgaattgtcccattgcactgtcccctgttgtctgagactgcactgtgggccaaacacccatggcaggccccacggaggggactctgataccatgtcatctccactcagtcatctaattagatgttggtcaggtacccactggaggccggacagcacataaaggtggggagggggtttgtggggggcttctgatggagacgagtagaccaggtgagtactaaatgactcaatctagatgagaggaagaaagggtcataggtattcattcggaacccagaaggcctcagacaagtgctgtgcacctcgccctggacaacccagcagggtcaccctgcagctgcagggcaggctctgagcttgggcgggcacagactctgagcctgggcagcctgagggtacagagggtgccagaattaggcccctttcgttgcctttgggagatcaatgcctgcaagggccccgatgcagccaggtggaaggggctcagcgtggggacagtctctcccatgtgctggctggcctggggacagctttgcctctgcggattagtgtgagaggtcaggacccccatgaagccatgccccccccccaccaggacatgagaaggtaccagctcctggagttttgtgtcccaggcctggtcgggacacttgggctgccagggggcctggtcctgggccactctcaggccaactccaggctgaggaccgggagctggaggaaagggctggtggtctctgaaccactagcttccctgtggttcctgccctggtggctgaggttagtgcgactcccctcaatccagcccggtccagaacgttctgagttggggatgggagcttcttcccaccagagaaagcattgcaaacctttttgtggtgaaaacatccaaatggacagaaaactagagagggtggatccatgaccctatcgcccatcacccagtgggcccagttcttgactctgttttgccaagaagggggatcaagtccccagcttttgaagatatgccagactgggtttgaaaacttccgcttctctcagacagagcactttccaacccttggccctagtgggtccatctatgatgcggagacaggaatcccaaactcagagggggctgcgaagatctaatgaaggaacctttgtgaggggctccctggagaggcagacacactgagggtgaggaattcaggttggacctgtctccggccacagccagtccagggcttagcccatccttgctgtgtgccgcagccccttgctctcagctttgactctcacaagcctcaggtcctctgtaggcactatagagaggcgatagtcaggccccactccatcctcctcctccctgctgcccaccgaggttccttcaccatctggacatagccctgagcccgggctcagctccagtcccaaggcttgggcttgcagggcatcagctccagcgacctgccttctccccccatcgagggctgtgtgacgtgtgtgtgcatgtgtatgatgtatgtggttgtgtgtgtgtggtatgtgtgatgtgtgtggtcggcagtcagctgggtaggcctagacctgcccagtgaccccagggacaaaggagcagtcctttcggatcctcccagcgcagggatcctctgatggacaaggagacgctgcagtcagaggcactgtgttttcaggacagactgaggcaaagcattttggcaaatggccttggagccctgaacaccctgagaccttgtcaccgccaagcccccggaccaggtatacacagcaattctaaatttgctaatagcctcattaaaaagcaaaaggaaacaggtgaaattaattttcataatatattttacttaacccaatatatctaaaatgttaccatttcaaagtttaatttgtatatgactgagatattttgcatttctcttcatgctccgtcttcgaggtctggcatgcacccggcactcacagcacgtctcagtgggaccagcccggcttccaaggctcagcagccactggagacagcacaggtctagtgcagttgctctcaactctgctgtgcattacaatcacctgagagctttgaaaaagtgccagtttccgggctgcctgggaaccccctcatagttacatgggaatctcagggaggggtggggcagacaggggtcactgatcctggggtgggaggtgtcacagccccacggaagggcttcccatcagagggaacagcgtgtgcaaaggcaggggagtggggaagagcaatgtttagggggaactgtgagtggtggtgtgtgtgtgcagttgtgtgtgtgattgtgatgtgtgtgcacatgtgtgtgttgtatgtggtatgtattatgtgtgtggtgtatatggttgtatgtgtgtggtgtggatgtgtttggtatgtgtgatgtgtgcagttgtgatgctgtgtgttcatgtggtgtgtgtgtgtgtggtattctgtggtgtgtgtggtgtgtgtagtgtgtggtgtgtgtagtgtgtgtgtgtggtgcagtgtgtgtggtgcattgtgtgatgtgcatgtgtggtgtgtgaggggggtatattctgtggtgtgtgtgtggtgtatatggtgtgtgtggcgtgtgtagtgtgtgtgtggtccagtgtgtggtgcagtgtttggcatgtgtgtggtgtgtgtgtggtgtattctgtggtgtgtgatgtgtgtggtgaaatgggtggtgtgtgtgtgtggtgtgtggcgtctgtgtgtgatgtgtgttctgtgtgtgtgtttgagtggagagatccttcaacctgaaggatcctgagcctttctcttcaggacaggtgaggacaccttagctggtggctgtgtttcctgcgctggggagtcagccgagcggagccccaccatggctaggtgttacatatgttcagtatcacctctgacttcaaaaaagcgagcacccccatttccaggaatcgcctgggaaccgtttcaaaggagtcgtgccagccaggacagagagctgggaagcgggaccacaggagcaactctgaacagtcattggatgcgctctccaaccagctgctctgctcacctcaaagcacacaccaaagagagggagaggctctgagcccatgcgggtgaatcagggtgagccacgcaaatctgctggcccctggcagtcatggcagatgctgccaggaggcctccctcattactcggagtaggcttgaagtcatgctttccagtgtgaggtgcgcgagccaagcaaaggaggaggcctggtcaggaggggggagttccctgtgacaatggaatgaaaaggctgctgcagggcccagctggccctgggcacggtgtggggaggggaatccgcaaaccaggcagagccctccagcccagggcgttagttgttgacccatctttcctccccaccaccagactgggagtcctcatcctttgcgctttgcagtttaggaagcaatctctgaagagcacaaacctatttaacaatgataaaacttcggctttaaagggctgatgtggcacactggcactagagccaggacacatgagggagatctctcttctcctgctcagcagctggcctcccttctgagggcccacctcggactgactggaggacaccacttggaatggcaaagatgggggcaatgcaaaggccacaaggatggcttcatagacaggatgtggacttggcattgggcagacctggatttaaattccagctctgcctcagtctgttttccattaaatgaagatacttgtgcaagggttctgtgagaattccagtggctgaagtgtgaagcattccccactcagggttgcacagctgggactgggtgaacactgttagtaccctcaccctgtgtgctgcagctgcatcagggccagctgcccttctcacaagcacctatgcacagatagcccccatttcaccccaaaggacaactattcagagaattaccatccatcaagccagggcactccaatcagaggaaggtgtcacttcctggtaggacaactagaagggcaggagctattcactgagcataagaggaaggcatggtacaggtggggcatttgtggagagcaagacagggagcagagaagtttctggcaacatgctgctcccagaggaatagggctgccacacctggtaccaggaaactggggaatggccacagctcagctctgccactcaagaaccccacttgccacctgcataggaaaagacaacattgtggccacagaagggtgaggggccccacagaactggggatgccaggacacttggtccatgggaagctgccttttgctctggcctgtgcctggaagcaaaaccatcatccataactccatctaaggattcttagagcagatactagctggaccacaaggggcagcccaaacctttctgttccatcccatggcctggcccttgctggcccacagctcacagaatctgctggggctccccagctcaggcagtacaatactctgttgaccatacgctgacaggtcaggcactgctcttcctagttggacctgatactagtcatgattcactcacctatgcagaagcctgtgcatgcaacaaggcttagcccttctcccatggagatgaaccttttgttcctccctcctgctttcaccacccccaccctacccaaagaagaggaagaaaacagagtagctttggcaaccttttctacccctctcccaggcaagaaaagcagaagaacaacctgaagaaccaggcttctctcctatatcctccatctcgccttcagcctgcatcccttcttactaccctctctccattataatttgctctctgtacattttaaatcaatcaaattagcaaaataaatcatgaaaaccctatacatttataaacatagtaatatgtgatgctcataagatgcaaggagatgggtactttcatagtgttgatagtaggaatataaactgaaaatgctttttttggtaaggcaatttagccatttatatcaaaacattaaaaatgttcatccctcagacccaggcattcagtctcagcaatgtatcctagagaaatctaaaatacaaaagtcacaaagctcaatgcaagaaaatgttatcatcttgctaattacaaaagtggaaaattgaaaacaatttcaatttacaatatatggaactggttaagtaaatatagcaatgggatacaacattggacaggctctaaaacagtgtttaaccagaattattaaacattcattttgtagtatgaagtgactatagcaatgtaatacaacattgggtagactctaacatggtgtttattcagaatttgttttgttttgttttgagacagggtctcactctgttgcccaggctagagtgccatggcatgatcatggctcactgcagccttgacttccccaggctcaggcaatcctcctgcctcagtcttctgagtagctgggactgcaggcatgcaccaccaatcctgtctgttttttttttttttttttttctatttatttgtagagatgggatttcaccatgtttctcaggctggtcttgaactcctgagttcaagtgacccgcctgctttggcctcccaaagtgctgacattactggcatgagccactgtgcctggcctattcaaaattctaaatgtttactttgtagtgtaaaatacatgtggtaaatttattttaatatggatcctataaaatttcatatacagtatcaatctcaaagacatttaaaggtttttgtttcaaataataggaaattgaatgaaaaggaataaagcaaaatgttgactggttgtcatcaagtaataactgtgtattatttattttcattcatatattcctaaattttctaaaaggtttatactgttttgaattttttttaatctttaaggaaatcaacttttatagcttagagtgggtaaattttaattaatatgttccttttgtcaggaatatttgcaatctaaacacactttaaactttggcttttctcttgtaccaccctgttgccatttaccaaactatagtattcacagcctatatgtttattattgcttcagtcctcattgattgtatcctatggactatgcacctatttaatcctcatacagagtatactctgtaaagtatgctgtctgacactgaaagtcagaaagtttgagttgcttgctcaggacaccaaaggtcatcagcagaggctgcttgatactgtcagtacttttcagatagtcactctatcagggctttagtccacagtgctcctgtggatgctaaccctacctgggattgctctccttttccttgagccctcctgtcttaggctgttttgtgttgctataacagaataccataccctgggtaatttataaagagaagaaatttatttggctcacaattatggaggctgtgaagtccaagagcatggcaccagcatctctgctttcatgttgcatcatcccatgatagaaggtggaagggcaagcaagcacatgaaacagagaagggagggggccgaacttgatccttttatcagaaacccactcctacaataacagcattaatccattcatgcaggcagagccctcatgagctaatcacccctcaaagcaccctcctcttaatatcatcgcaatggcaattaaattacaacatgagttttggaggcaatgctcaagccatagcacttctcaagaagggcaccagcagaatatgcttgtgatcgctctgaatctccatcaggtcatagcatggaatgaaggtatctggtttactcaagcatccctcccacggcctgaggtcccaagattggattttctgttcccatcattggaaagcagaggaatccttgtggaagtgcatctgccttcacaggaccacaccaggagcaggaattgtaaaatccacctctgctctcccaagagagaaggagagggagggaaggagcacatttggcaactgagagcatgcaacagaaaccattccttggagatcctatggggcaagcaatggaagggacactaatttccatctggaaaagatatggccagagctctgacttcaaactctggaaggaaggtgggggctgacccctattgaggatcttctgggcaccagatgctggactgggtatttaattctagtcaatttattgagggaatgagactccaaaaggtgaaataccttacccacagtcatgcagctggtaggtgacagagatggagctgaacccagactcttcctcttatccagtcacataccgagaccctgcattgccgttggaagctatttgcctttcttctcagcactctgggtgtcgtttgcgtgctctctctctctctttctctcagtaacttcagactagagaatggggtaccaaggtcactgataaggaagcccagggcctgggggtaaattttagtgagtcggcagtcctcaatactcagacagatcatcttcttcatgatgatgaagcaccatcaggagcttaccatttggagagataggatggcttaaccctgaatctgtgcctgactggggtctcataccctggggattttatagtgtaagctcaggaaagggattctgatgcctgagcagagagaatgccctaattaagaatgacggccagtttggacaatctccctgaatcccaccgacaaaagaaacaatggcttcccaatgacatgggtctcaagatggacttgggcagagcaggaacatgcaggggggttggtggtcttccaggaggcagggataaagcccccagcaggaggaagggccccccaaggctctccttcctatctctatctctggtcagtatgagactgagtcattcacttagctaaggaccagacaattaaagcacaggaacagatccaagcagatgtataaatctattatatggtgaagtcatactataggtcagtgaggaaaggatgagttccttaaaaaatatattgacacatctggttatccatttttaaagaaaataaagttaaattcctatcacataccatgtacaaaatttccagatagattgaatagctaaatgtaaataaataaataaatacacacacacacacacacacacacacacacacacacacatatatattatattataagaaaatgttgtgtaaccttacaatgaggatttctacttaaataaaataggaaacctaggcgaggtgtaatggctcatgcttgttatcccagcatcacttgagctcacaagtttgagaccagtctaggcaacgtggcaaaactccatctcaaaaaaaaaaattagccaggcatggtggtgtgtgcctgtagtatcagctattcgggagactgaagtgggaggatggcttgagcccaggaagtggcggttgcagtgagccaagatcccaccactgcattccagcctgggcaatagagccagaccttgtctcgaaaaacaaacaaacaaaacaaaacaaaacaaaacaaaaaacaggaactctagagcccataaagagaaaaactaacttgataaatttggttacataaactttttaaactcctgattttgtaagccattaaacagttttttactagactagaagaaaataattgcaatacttaaaatagacaaaaggtttatatccctgatatgaaaagtttatgaaattaataataaaaagacgactataaaacagataaaggacacaaagggcaattaacagaagagattatacaaatgaacaatagcatgttacaagacaacagtgttgggataatgcaaattaaaattcatcagtttagcaaatgtttaaaatgttggtaccagtagtctaattttgatgacactataaattgctacaatgattttgagaattaacctgacagttactgctgacattttaatctggatgcccttggatgccacttctggaaaaggccagggatcataatcaaaacattaagttactcttacatcacaagcatgccctgatcagaacagacactgaccacaataaccaacaagactgtagcatacttaaaaatagatgtatacgagtatgctccttgtacaattgtttatgttagcaaacaaacaagcaaacctggaaacaatccaaagtttcatctatagggagaagaataactaaattatgaaggatcatcaatctggaaccactgcagctctttaaaaaagaaaaagaaggtaaaactactattattgccctggcaggatatccactatagctgtaaaaaaaaaaaaaaaaaaaaaaaagtttagaaaataaaaataaacaaaggaagtaattcaattgtagctcttcaaactgagatggtaataacagcaattacttaagtacagtgtaattatgtcttcctgggggttggttacatcttggcaaagtttatcacagcaagaattggttttggcttctggggttggagccttagattggagatagaaaaaaaacctcaaaggaagcattcctgtccagaaggtaaagtgattcccacccccctcttccctgctacaaaaggtcatggctttggggggcactgaggtctggcatcaacccttaagtttatttttcccataaggaaaagcacaggagtctcatgctagcactttagagaaccaagcatgtggatctacagttccagggaagtccctgactcggggacacccttctcctgaaatccccacactcagtcagggccctgtcatgtgttcccatggcccccagttctcttcttggtggcacataccacacgggtcatttatgttaggatatgtacctctttttccctccatgagactctcagggggtcaccatcatccccagcacctagacagtgcccagagctttgcatatacagggtaaatatttaccacgaataaatgaaattagtaaggggctacaagaacccaagatgattgaagagatataccaagaaatgatcaaatgacagccagagtgtcagtcactcagctggttccaaatgcctaataaaaattaactccctctgtccttaccacagccctatgaggtggccacacttattgtgctcactttatgatggggaaacaggagcatagaagttgggcaactttccaaagtcacaccgtgagcgattccacaacaaggggttgaacccaggctgtctgggtccagaggtcttgttcttaaccacagtgggctgctgcctcttctccctaagctagtgcatcctggaggtcctcagaatgacttgaactggccagagggtaaacgtctgctgaaggaatgaatgggcaatgaatttctaggaacctggggccctggggtctgggaaggccgttgcctccccaagggaatgacacagggccagtctgctctccttctgtgtgggcccctggacactggtctggcattgtccagacaccaaagcacatccgcatagcatgcatcaaacaaatggtgacctgctaatgaggaaatggctaaaacaggaagccatgaccagagtacatgcttcatgcctccagccccgcattgggtaatggaagggcaattacttctccacctcttcacctatacagggcagacttgcctagaagttcagagtccttcctgccaatttggcatcctttcttccagagtgttcccaggctaggtggggatgggaaaagccacaaggagcacagcaggatgatagagatgtggccaatgggcaatgctggcactgccaccctggccagaagagctcactgtgggacactttctcattgtttactagggaagaggaggttggtttggaattcattttgatttgttgttgtaaattctctttgctgtcccaatttaaacaaaaaagaaaatggagaaggggagtttttaatcaaatggattttcacttgggttttatcatgaacctggaactgctttgaaagctgaagccagctgggcttctgggtcgggtggggacttggagagcttttctgtctagctggaggattgtaaatgcaccaatcagtgctctgtgtctagctagaggattgtaaatgcatcaatcagcattctgtaaaaatggaccaattggcactctgtaaaatggaccaatcagcagcactctgtaaaacggaccaatcagcaggacatgggcggggccaaacaagggaataaaagctggccacctgctccagcagtggcaaccagtccctttctgcactgtgggtgttttgttcttttgctcttcataatgaatcttgctgctgctcagtgtttgggtccgcgccacgtttaagagctgtaacactcaaggggagggtctgcatcttcactcctgaagtcagggagaccatgaacgcacctgaaggagcaaattccagacgcccacctttaagagctgtaacactcactgtgaggtccacagcttcattcttgaagtcaccaagaccgagaacccaccagaaggaataaattcctgacacagcttgattttgtctttggtgagaattaagaagggtcacatccactgatgaccagttgggggatagatttacactggctatgcccagtggtactcaaagagccacaattactctcactgtggagcttccttcagtgacaccagagaccaggaagggagctacctaggagacctcagcctgtggaaatcaaactgtggtgtgagccctcctgttagcgagcagtggtgctggctgccttctcacactgccacttggcaaccagaatacagggacttcaccgtgagtttgagctaaaacttgcctgctagtgaatcttagcataggtaattttgggttaggagaattttggtttctctgatgacttggttgacatctttgagattcagcaagccccaattcagattagacttaaaacttatcagtgcaagtcagacagcagtgattactctgcttgttgagacctagggacatccgtttgaattcagtccgcaccccatggacgagcccagctcaatgccaggaagtttatgaattcctggggccttctagtctcatggttacatctgctgccaaaaaccagatcctatgaagttagttcagtttagtgatcttctcaccaagctgcaggggccatcctgttttgtaccatggtgatgaggcacagagcacaccctctttttaccttcaaagaaagaagccagacattgatacaggttactgtgtatgcagcagactatcctgaaggtttagggagacagagtattgatatctcagatctgcaaacaacagaacagccccttggggatcactatgatccaggcagaaggcagaatttgttttttaatcaaatcaccaattaatgactgaaaacagtatctcctggaacaagaaattattattcctctaggcttgaaacaatatgaaacagaggaaagttatttgcaaaaattggctgaatgtgcaaattatgcttccacgtgaatagcaaagtaattaaaaccattttcagaaagtgaactactttcttaaaacagcatgccgaaagtggtccagagttcaagattttgaaaacaaaaacaaagttggtacttgaattcacagattgaagctaactagaagtcaaagaaaagacacactggattatgagaaggagcagggatcacagccaggtgcagaacaaagtctgagcgtgcctgaccttccctggaggttccgcccatgtcacctgcccactgggtgtttcctgttttgaccatgcattccttagaccttctgttgttaaaattttttctccttgagaactttaactggccagaaattagaatccaattttgaaaataccaagctactttcattatgacactgcagttaagcaaatattacccaaatttggacagccttgtccaaatttgttttatattgttttatatttagcaatataaagcaaagtgtcccatttaaaaattggtaaaaccttataatcaatatgcattaaaaatttttagtatcacatcattattaatggcaaaaatttccatttataaataacagaacttttgttgattgtatttattcttccatcctgggatttggggttttttcaattttgttttttaagtttgtttttaattttttttttttaattcagaaagagaccttgttgccaccctctgcatactcagaaaggaaccccagtccgtgcagaaaggggccacggacagtggctgtccacccaggatgggcccaagaaaggagtcgatgtcctgaaacagtccctgcccctttcctgagtgttgggggatggtgggaacgacgaccatgtagctcctaacaaagggcgtctgcctctgggggtgtcctggggcgtggcttactgagggcttactgaattttaaaaattcagatttcagccaggcacggtagctcacacctgtaatcccagcactttgggaggccaaggtgggcggatcacctgaggtcaggagtttgaaaccagcctggtcaacatagtgaaaccccatctctactaaaaatacaaaaaaattagttgggtgtggtggcatataattgctgtaatcccagctactcgagaggctgaggcaggagaatcgcttgaacctgggaggcagaggttgcagtgagccgagattgcatcattgcagttcagctgggcgacaagagcaagactctgtctcaaaaaaaaaaaaaaaaaaaaaaaaaattcagatgtccagcttttcatgaaaaaatccaaagttctggtcacacgctggacaacaatagccataggtgagcacctgctgccctgggaacaggcacgtgccctccaggtggtgaatgacccacttctctcaccagcttcaattgtgtccatctaggacatttggaactcttccaggctgctgcactcaccaatggcaccttcctggcctcatgggcatttgagtttgtactcctggccaggacctaatgctgcagaccagataacttcctgggttcttgccctaaaggaggagctgaagccataagcgcagacctctaatgtggctcagagacactgtggagagagggcagtccaggcccagggtcttgacggtcccgcccctggacttattaggccccctctgcatagctcatagtggcagtgataccagacgtcacctaaaccttcccactcctgcggcacccactaccattcagcctcagggccatcctaaccttaactccaggctcctctctcacatgggactattccagctctgactttagctcccatgaagaactggctcccgagtcctggctccccatccaggacccaggttccagtcctctcaatgggctctccctgatagaggtcaccttgggtctggtggcctaccccatttcttacaacatacaccccacaccagccttgggccagccacctcctttgtgccccagaatggctgtcagggaagaccctgcctgtgtgccccaacctgtgggcaaggcaaggcctagggctctgcccaccaggaataacagacccagctagggaaaggcaggctttgagatgcacgtgtgatgttgaccctccccccgggtcaccccaatacccgtctgcctgattctctgttgccccacagggtcccagagagtgctgagctgcacatttgacaggctatgtgcccatgggtccaatgtgtccatggatgacctgaattccaaggccatcaggaaaagcctattgtgttgggcccccaggaagccaagccaggctggctaccctgggatcttcagaggagagcagcctagcttgtacagatcccctccatgggccaggccctagaaatttcacacaaaaaaattatccttttttacagcaactcatgagagagaccatgaggataccattttacagatgagaaaactgagagtgaaggaggtgatgcaaccaatgagtgacagaacatggacatgaaacatgtcttggcaactccagtacccaagatttctccatgtcagctgtcagcctgcctggctcacaaaaccttcatccccagtgtagaaaggactgatagacaagttaggggcttctctctcacagggcccttgtgtgtgcccacccttcacacacatacacccattcacacatacatacatacatctgcacacacaaacacctatggggtccacacacatgcacacaaatacacgcacaaacaccctgcatatccacacatacacacaggcatattcacacatatatacgtgcacctgcatacaaacacacacatagacacaaacacccataaatatccacacacacacaaacatgcacatacacacaaatactcatacacaaacaccctacatgttcacacatacaaactcctgcactcacacaaacaccttccatatccacacatccatacatatatattcacacacacacacacacgcatgctcacacacacgagcagagcactggaccaggagcaggagctgggactctcgtcccagatctcccatcacacttctcaagccttggcttcctcatctgtgagatggggttgtgccgcctgcttcccagagtgttgcacaagcaaacatgcatgacagcccaggaagtgagaagggtgtataggaggaaagggtcctgatttttggcagaagttgcccagggagtagtgagtgctccacacctttgtatgtgctgtaccttctctctggagctcttttctcttcttctctggctggtgaactcatcctcaccttccagctccaacaaccacactttgtgttcctgatgtctccctgtagtggaattcctccaccatcctcagtgtccccagctcctgtgtgagacaggacttcctacactggagtgggacacgtgaatgaggctgcatggctcttcggagccggatgagtcccgacttctcctgccacaacccaagtcccttcacagacccacagcacagtctctcagaggtatcttttaaggccagaccctggccttccctttgacagcactgatgcaaagctcctgatgtgactaggagtttaagaaccccctaagtgcccctagctgcctggtatagacctgccagcctctgcccatcctgcttcatctgctctgaccttttgctctctggtggagtccttgccatgatggcctgggcccagtctggtctggcctagggaggcgcttttctgcccaggcatcagggcctgtcctcacgcagagttcagaacacacagaggcaccccatcactctcgaggtaggcctcacacctcgcaagtcagcctcaaaaaagcaagtatgaggcaggatcccctttctggctttgggtaggggctgcagttcctcttgccatgtggaagcttcttaaatattgtactacaatatttaaaaatattccctttgttctacataccattaatagatcaactcttctacagctctgcaatcacttctgacttggcaaagctgagcctgagctcagggaagggctctggcttcagccttgtgaagcagaaagatcgtggactctcgcacaggacccctgtttacatttctctcaagcacagcctcaccttctcagtcctgctccaaaaacaccacacaacttccagttctgagaatgcaccctgttctctcagccctgggctttccacatgctaaccccttctcagaacctcccttccttcacttcgatacctaactgatttctattctccttcaaaaccccattctaacatcacctcttctgggaagcttctctgacttctctgaggccctcccaggctatcatttccttcctgataatggctccttatagcactggccacttatatggaagtggtgcatttgagtctctcccactgcaccatgggttttcaatggaagagtgtgtgtatcattcctctttgtaatcccagctctgtcatcacaagatggaattcaagcatgtacctggtagttgatcaagctctatattcatagagcccaaacccaaacctaaaccaagaagaaagaagaaaataatagaggctagtctagaaataacatagaccaggctaattccttaataataaagacaatagagaaaatacttccccaacccttgctaatgccaatgggaaaaaaatagagaaatctttaaaaaccaaaattggttatttgaaaagattaacaaaattggcaaatctttaactatactgaccagaaaaaagaaagattaaaatcagaaatgaaaaagaagatattacctctaaccttcaaaaataaaaaattataagtgaatgctatgaacaattatatgtcaataaattaaatgacttagatgaactggagaaattcctagaaaaacacagaaaccaaacctgactaaagaagaaatagaaagtctaaagaaacctttaacaactaaagagatgaaattagtaatccaacaactaactgcaaaaagaaagccaagccccaatggcttcattggtgaaattaaacatttaaagaataatttgcgttttaaaaatatttgcatttaaaggagcttttaaagaaaaattattatcaattcttcacaaacttgcaaaaagttaggcataaacacttcccaactcattctatggggccattactattctgatactgaaattagacaaagacatcacaaaaaaagaacactactaatacctcttatgaatatggatacaataataacaaaatactagcaaactaaattcagcaacatataaaaaggattatacacaatgatcaagtgcagtttgtcccaggaatgcagggttggtttaacatccaaaaaatcatcaacgtaataccatattattaattgttctattaatactatattaatagaataaaagatcaaaacctcataatcatctcaatagatacagaaaaaaatgacaaaatacaaaactccttcatagtaaaaacactcagaaagaataaaagagaatttcctcaacctaataaagcgtatatactaaaaaagcagcaacaacaaaaaaaacatagataacatcacatttaatgggaaagacaacatgctttccttctaagatcacaaaagaaacaaggatgtctactcaccacttccattcaacatcatactgaaggttccaactattgcaattatataagggaaaaaaaggcacccagataggaaagaaagatgtaaaatggtctcaattggcagatgacacgatttttctatgtagaaaatcctaagcaattcacaaaaaaattaaaatatgtaaatgaattcagcaagattttagcacatgagatcagtttgcaaaaatcaattctgtttctatacactgtcaatgaacaagacaaaaatgaaattagaaaaataattccatttacaataacatcaaaaaatacttaggaataaagataacaaaagaaatccaaatggtatattccgaaaaatataaaacattgttgaaagaggtcttaaaagatcaaaataaatgaaaatacatatcatgtttttggaccagaagacttattgttaaagatagaaatatcccagagttaatctataagttcaatgcaatctctatcaaaatcccagatgacttctttgcagaaattgacaaggcaatcctcaaatttatatggaaaatcaaggaatgcagaatagccaaaataatcttgaaaaaagaaaaacgaagctggagtactcacgttttccacattcaaaacttactagaaagctacagtaatctaaacagtgtgatactagcataagaacagatcaataaaatagaactgagagtccagaaataaatccatgatctatctacatacatctattgtcaattaactttttttttgagatggaggcttgctctatggcccaggctggagtgcagtggtgctatctcagctcactgcaacctccacctccctggctcaagcaattctcttgcctcagcctcctaagtagctggaattacagacacacaccaccacacctggctaatttttgtatttttagtagatacggggttttgccatgttgcccagctggtctcaaactcctgagctaaaagtgatccgcctgccttggcctcccaaaatgctgggattacatgcatgtgagccaccaggcccaactgtattgtcaattaatttttaacaagagtgccaagaccattcaatgggggaaataataatcaaataatctcttcaacaaatggtgctggaacaactggatatccacatgcaaaagaatgaagttggactcccatcttacaccatatagaaaaattaacttaaagcgggtcaacaacctacatataagagctaaagccataaaactcttagaagaaaacataggagtatatcttcataattttagctttagcaatagagtcttagatatgataccagaagcatgaacaacaaaagaagaactagataaattagacttcataaaaatagtaaactttcgaacatcaaagaaaattaccaacaaagtaaaatcatacatctaataaaggtctggtatccaaagcatttaaagaactcttacagctcatcagcaaaaacacacaactcaattttaaaatgggcaaagacttgaatagacatttctccaaagaaaatatacaaatgccaacaagcacatgaaaagacactcaatatttttattaattagggaaatgcaaatcaaaattgcaatgaggtaccaattcacacccactgtatatatatgtaataggtggatggatatatataatatttatatataattatttataatatgtatatataataatgttattatatgataaattatataatacatatataatttattgatttgagacaggctcttgccatgttatccaggctggagtgcagtgacaccatcacagctcacagtggcctgaacctcccaggatcaagtgatcctccacctcagcttcctgagcagctaagaggtactacaggcaggcataaccatgccctactaatttcttaatttttttgtagagacaggatctcactatgttgcccaggctggtctcaaattcctggcctcaagctatcctcccaaagtgctggcattagaggcatgagccactgcacctgacttaggatggatatatttttttcaatggaaaataacaagggctaacaagaatgtagaaaaattggaaccctcagacattgttggtgagaatgtaaaatggcacaactgctgagaaaagtttggtgatttctcaaaaacttaaatatagaattatggtatgatcaagcaattccactcctaggtatatacccagaagaactgacactgactactcaaacaagtacatgtatctttatagcagcactatgaacaatagccaaaaggtggaaacaacccaaatttccataacaaatgaatggataaacaaattgtgatatacaatggaataatagccataaaaaggaatgatgtactgatacatgctggaacatggatgagctaccaatttacaggaaacacagaggacaggggacatgttgaatagcaccatgagagtgcagtcagcaaaatccagactattggaaactctacagatcaaatgacctgggtcttgggagggggtaggaaaacctgtgtattaaccaacttttaaaagatgtatttttataaaataagtgagatttaattatagggtgtagggatatacatgtgggtaataattagactatgaagcaaaggaaaggagtgtctactgtaagtcaaggtagtggtgactttggagaagagagtgaggaggtgcctctggacaaagttctgtttcttagtctaggtggtggttacaaagctttactcttgtaaaaatccattaagccatgcatttgttttatgtggcttcttatagctttgtttatttgcaaataataacctggttcagagattctgattcacagggtgtggggcagagttcaggaatgcttttaaattttcccgtgttgtgtgcgcacacacacacacgcatacatatatatctgtcttccacaccaggctggtgcctgtttgaggaaggtctgtggcttgcctcaatttggacttcccaacctccagaactataagaaataaatttctgttctttatgaattacccagcctcaggtattcttttatagcaacacaaaacaaaccaagacagcttctatctctctcctactgacctatgagcagggcatgctttgtttctgtctttgcattcagcacctagcacacagtaagtgctctgtaaatgctgatgaggctgggctgatacacaggtggactgacagtgggcataccagacaagatccagtggcccctgaagcagtcaactcacccacagcaatgctggagggctatgaacttcccaatctcactgaggaccacaggagcattccacctctactgggcagtaaaatccagaacgccggctgcagacattccacttagagtcatgccaacatcctctctgggccccactagcttaagacagagccacagacacaggcgtccagaattaagagtccatctcagccctgaggctgatttctcactacacactgaccctgagaaaaacttcagggactgcaaaaggcagccagaaacactgggagaagggagggaagaaagcgcctctgaaatagacagaaacactaatgcaccaccagtgcctctttcagacataagccagtccagctccccatgggcaggcccaggatcacacaggacactacaaaccaggtctctgcccaagaaccaggctgtaggggccaccagagcctcactggaacaggttaatgcagaatacagtcatgtacgtccaaacggagctacaggccttccccgttaaagacagtgccctccccggggtagaaaggaaaacaatactccttatcagcatgaccattgtatgttaagtcttgtgatgcatgtttgcaagttactccaagtaactatggatcttgtccccaactcaggccagccagctgacaggccctgaagtcagcagctacagttggctgattctgaacccagtgatgcctgctgtttgcagggaatgagatacttacttaattatctcaaatttaaacactcttatatgtttccttaatttaaaaaccatacacacacagaagtgaggacatctaaaaatgggatctgcgttactgatgtgtaagccagaaaaaaagaggagttctcaaatacactctgagctggacttcacagctacgccagttcctcaagtggttcgtggaggtgagcggcagatgcaggccagtcttagaatgtgaaaaatctgagagctataagacaattcaaaaacagacaataagtcaaatcccattgaattgtgttattttaaatataaagaaagaaatgtacaaacatttaacagaaaattagattccccctgtccccacaaatcaaatccaaaattacccatgtgaaaacttcacggcattatccactttccaccaaggcctccacgtgctcgttctctggccaggccttggtagtgtggactggtcaccatgtaaggacagccttctgtgagctgcagaccaagggaggtggcctggcagcctgttggaggccaggcaaggataaaatttactatcaatccttttttttttttttttgagatggagtcttgctctgttgcccaggctggagtgcagtggtgtgatctcggctcactgcaacctctgcctcctgggtcaagcaattctcctgcctcagcctcccaagtagctgggactacaggtgcatgccaccacacccagctaatttttgtgtatttttagtagagacagggtttcaccatgttggccaggatggtctcaatctcttgacctcgtgatctgcccaccttggcctcccaaagtgctgggattacaggcatgagccaccatgcccagccatcaatccctttttatgtataagaaataggctcagagaggccagatggcatggcccagtttgcacagtaaggtgattgcctgtcacggccaaatagccaccacgtccggataatccatggccactggtttctgtgaggtggtggagaggcggcctcagcctgagccctctggatcgtgggcaacgggtggtgtgaggaaactgtccagcagtgatctactgtccctgcactcccacactgcagggccaggggtgcatctgcatcccacgcggggaatgcctgggcatgaggcttcaagaagcacttagcaggaatgcaccgggtgctcagaggagccgctgtcctggcaggctttgctgtccacatttgcccctttgcacggagcctgctgtccctgaagtgctctgacctgtccacaggaaaccaggtcaggcacaaaataaccacccttgtctcaaagcaagggccctaatgcctccattccttcaatgccttttccttcagccaaggtcccctgcagtcttgtcctgggcactgaactgggtgctggggatgggctggattatgaggaaggaaggtctctgctctcaagaagaagtgggtcccccatcctagggcagaaggcactgccatcctgagtcagcttatcgcagctcagatttcactccctctgtgctgggccctgggaatggggagatgacactgccatggccctgccctcaggggctccccatcacgtggggaagccagacacaaaggtaaatttgggaggaagcccccaatgcctcataagctatcaaaaaccagagtccacagcaatgggaaaaacaaggcaaggaaggtaacctgcaaagaaacgagggctggggaggcaacacgcaaacagccagaggagactgtgaggaggccccccacagactcatcacctcaaagcggagccccaggaatgaacagtcagctctaggacgtgctaaatgccccaggagaggcacgaaccaggggaccactgacaccactcggccttcggaggtgagaggcggcttcccagaggagggcatattggctgagcaggatttcctcaggtagacacagggggaaaccaagcatcgcaactgaaggccaggtaacacagatctgccgaaagagacatcatgattttcaaacaagcaaacgaaagggattcattctattctgcaactgtcaggcatactcagaccaagagtaatctttcaaataaaccccagaaaatgaaatcacgtatgccatgttctagccccgcagtggaaagtggtttagcctctggtcccggagtcttgcctgtctcttctcccacccacctcccctgcctctctccccttcccagctgcccagaaggtgactaactgcatgtccacttttttttctgctgattcttcccatttctgatattaagtagcactttctctgcaagcaaagctacactgatataatacagatgaaactgggaaagtccaggctaaatttcaggatacgtatacagaaatgcgttgagatacagcacctcactcagcaaccatgccttatagatagtgctaagcttcagtcgcatcacagaactttctaccctgcatgagttctctgacctggctgtgagcttcttgtgggtggggtctcagtcattcccaagcagccagatgtgtctcagtgcctggcatacagaaggcatatgataaatgtttgctgaatgagtaattcacaagtaggtccattgttataaatgaatgttttggaaacacaagctgtcactgagttccacgtgtcgtgttctgctttcgaatgacctgccctgaatatatctcacatgcagtcttgcatatgcctgattcagacttttgctcacagctacggggaggtgttgagctctgcatgggccagcagatccaggcagaaagacttccatgtctgtacagcagcatttgttcattgctccaatggtttattttcccctggttttattaaaatagtgaaaaacactaaagtggaagggcttacactcaagagcaacacaattggaatgacagcatgggttttcaggggtgcccaaagaagtccttcccctctgttgtatgtccctaggtcttaagccactacactgaattcatgtgtgaaggaaaggaacaaaattcaagggtgtgtatgaaatgctagcaatatagccttgaatgctgtacctggatgtagagcaggaagcaaggcttgtaccgtctcttccttacctctctgagaagggaccccaccccaaattgatctgctctggctccgacacaccccctacatacgacccactctgtggaggcaatagggaagtcctgctctgtgtctgaaaatgtcaaagacagcttattcctgggaagccatcaaatacgccctgctctgctgtatatattattcaagtactcagtaaaccctttgtttctggagagcaaaggccactggcagcccaacctctgcccagacaaggaggggacaggcagggagctggcaagggcacacaggatcatggccagagggtgagctcagtgcccagaatctgtccccataggagcacagggtccccaggctttcaattctccagacttcgtttcccagcctataaaatgcgtacaaaactgacatcctctcgggatgttaagattcgatgatattacaaatgtgaaagcactttggaacccataaactgctgtatcaatactggttgatcgtgctcttattaagattattctattaataacccatctcaaattacatatctgtagacagtgcgtttgtgcatctattgggccagctgctctccaggccgggaagccagaaagatctcatggaggagctggtcctcctacttccttcccttgctaaggccaaacctgcccgaatgagcttcatctagagggcacctctcaggctcagcacctggagcagccctccatgtggacagccgggcctgtccagcccaaccagagggggccgtggattttgtccatggctgtttcccagactccatggcagtgatttagatgcccctgccccctggccgcacgctggaacatgtgcacctggtttctcccggcactgacctacttatccatcagttactcaactgtctactgacgtgtttattgagcatgtcccaaaggccaggtaccagaccacttgctgcatgtgacatgcagacacatatggaaccaggccagcccttgaacaatcacgacaagtgtcccaagtgctacaaaagagaaggaagggatgatgttgcagaaagtggggagggaggggcagtgctaacctgctctggggtctctctcgaaatttccttttgtttgtcctgctgacctttctatgcatgcttttactctgaagtcacaccttttcttaacctgtagaaaattctcggtcatgtcattctaccactccttctactgtatcttctctaccattctctccacattttctccttcagaacattggttgttaaaactcagccattttttaagttctcttccatagtttcatctccttctatctgtgagctgcttttagttttccattcgcaaattgtatctttgactagctcatctattgatttaattatcatagtttttatacctagatttctactcagttttttttcagagccaatctgttcttaatttataccttcctgggtttattttataattactttttatgaatgctatttcttcttctttgtgggtcttaagatgcttaaggctttttggttttgagatttttctcatatttccatttatttggcagtgaattcatctcctattattagttttgtaacctttcttagaattagttttttcacatgcttcaaaatgttcgcttgcaataggaattctgtgttttgttcttcccactgcattaacctcccagacccacccgcaccctcccaggattttgtcattgctcccatctggccttctagagtacccagtcccaaatgaggcttgctctgacagctccgaggttctgaaatgccaaaacggaggagttagccagtccagtcattggcccagggcctggcccaggaactacctttgagcctccctttgcccccttttgccctcttaggcatgcaggtcttgctagccttagccctggtagcagttccagtattttgcagccacctgtcacaggtggctggatctgccctcgctcccagttcccatagcccctgacgcaagtgagatgctttgggctctcaggtcctttgcccatgtcagagcccagaggtgtggtctcactatgctgtggaaccccagctgacagaaccactcactgcccagggatcctcagggaggttgagaagggaaagcagattgctttaaaggccgccgttataaagccatagccaaagcagctgtggcctgtgaaatggacctacgagaaacacagcaagagagaaggtgtgaaaaccaggagcgcctctcagtccctgcatgaggaagcaatgtgactgtttgatggccctgagttatgtgggggtcatacaggccccttagctatatcatcattccaacagcacaaagacatgaaaaaacctacagtttgcaagcagctgccccagagacagactggcaacaccatgaggccaaatcatacaattgcacagagaaggcagcccttctgtgtgcctgtgcagccttcctccctcaactggcattgcacctagggcaggccctatgtccaaagtgagcagtgatatcagggttacttgcccaggtcactgaccagtaaacgacatgtatgtgtcaccggtcagttgctattggtataaacacttcttctgtaatatatatggcctagtatccatttgggatggttccaaaccataagttggggttctccaggtttggaatggtgcatttcagaaggtaaaaataccagaaattagactacaagaaaatgatgtgttagagaggagtgtggggtaaggagactaacagcagagaggcaggcaagattcaacattttgagatttattttgtgttattggcaagccttcataggctttttagcagggtactaacaaggaaatatttaggaagaaaactggtagccacatggatgagctgttggagagaaagagactagagacagtgtctggagtcaggccagccccaggttccagttttatactcctctgtaggtgcttttgttccaaccttggtccagattcactcctaaattcatcagggtttccactccttgaagtcaaagaggtctaatgaacacagcactttatgcatattacctttctcagccatcaaatcattacaaattagaacttggaactggagagagcaagttacttgcctaaggacacagctattagacaggtgtatgggcttcccaagtgatgcaccaatcctccctctccccaagcaggatgcagagggcagcaagggaggggttccaaatgggtgatgtggtgctctcgcagcaacccaaggctcaggttcagctctagccctcagtactgagctaaaactggccaggtgcagtggctcatgcttgtaatcccgtcactttgggaggccgagttgggcagatcacttaaaggtcaggaatttgagaccagcctggccaacatggtaaaaccccatctctactaaaaatacaaaaaaaaaattagccaggtgtggtggtgtgcacccatagtcccagctactcaggaggctgaggtgggagaattgcttgaacctgggaggcggaggttgcagtgagccaagatcacaccactgcactccagcctaggcaacaaagtgagaccttgtctcaaaaaaaaaaaaaaaaaaaaaaagaaaagaaaataaaaagaaaaaagacagtactgagctaaaactgaagacagttagggaggccctggtcatcctctcaccccttctcccttcatgtccattcacccccagccccaagcccagccagtggtcactggggccacacgtccccatctttgtgctttgcacatgggtcctctgacccagctgcctcccacctggatctgcctgaagaactcttcaatatacagcttctgttatcagacgctcatttcggggggacagctgccacaagtgtggcctctgcagccagagatccaagttcaaatcctgattctgcctctagtgagctgtgtgatcacagtcaagttatttcacttctctgaatctcagcttttcatctgcaaaagctgtcccaaggtcattttaataaatgcatacaatagctgctgcgaagcgctcagtattgctgagaactactggcgtctataaagttctgagtcagggttaacagctgtggcatgtatggtaattgtttgcttgcgaatcatccttcccctcagctgcctgtgagttcctcagggagaggagccatctttgattcagggctatgttccagtgcctgaaataaggcatacctcggaaatgcttgttaaacaaaggaaggaacgtgagagtgaatgatgacaactctctttgccaaacattctaccagtgactcctttgcgaaaactggctgcaggatggtgattttgatttgctgtaaacctagtgccaattgcttccatctgagctttagataggtgaagagcctcccctcgccccgggagtgtcacatctatagccagggcaccgtggataatccattaacacggattccctctctgcagcctcaatgaccctgtcagttcccagctgctaagaggttgcctcagccatgacctgggaccatgaccatcatacctgattcacctggacctcccacttggacaccctacctggacaccccacctgggaatcctacctggacatcccacctggacattccacctggacatcccacctggacatcccacctgaacatcacagcttttgccttcctggcttcagaaaacctaaagccaagcctggccacaccctgggagtagcagagctttggcctcacagaagcagcagatgtggagccaaactttactgtggcctgaggacctggctttgaacctagctctgctaactgactttatcaccttgggcaacttacttagcctttggggacttgatgtccatttatctaaaatggaaatagtgctagctatcgcttcttgagcactcatcaaattgacagggaaaggcctcattgttatttctattcagcatcgccttctcaggagcatgggtccaggtttctggaggatacctgaggaccaggagccctgatgtgtgggccgcacgcccacgtccctgcccagacaggcctcccctcacattgcaatttcagtccttggctgaaattcagtcccttggctattatactgctcccaggtggggaggagttgagagttagagacaggaaagaccaagaagaggaaggtgggagaagactcctctctgtgtttataaaaatgcttttggatgcctgctagcatcagaaagattttagctgccaattaacaaacagtggccacagctgaaggtgacaagatgttccttgcatcttaagctgatgctactgtttgcaagacatgagccttacattatgtcaaaaggtgtttactgaatgaatggatgaatggatccatcagctcacaggattaattaagattttcatcatctgaatgtgaaattatgtccatgtgcagagcctccattcctgcccagcggcttcatcacagccaggtccctgtctctcctgggtcccctcaatggctctccttcctcccaggtgtctggggaaggacagcagcagtaatccagggacagcctttatagcggatgaagcactctgccagacaccgctgccctatctctataggattctcatctccactgggagaaaaatacttactattataagctgcctcaaattatttccaacaccactaaggaactcatggtaaaatataaactcaataaagagctgggtatggctcttaccctgaggatagggtgcagctgcgagctgactgttctgagctctgccttagaacagagtggcagtgtttcctagtgcccaggtgactctctctgctgggcctgctgtggctcagccctagatccaacaaagagagggcaggagcacagcctaggccttcttctggcatcccagctcactgtgggttgcaactcaccagtgggtgtgaaatccatcacgactgagaccagtaagtttttaatgaaatgaaatacaaaaaaaaaaaaagttagagtttgtatatgcgtgcatactgtgtcacaccgtaatttgttttttttttgttgttgttttttaattttattattattatactttaagttttaggatacatgtgcacaacgtgcaggtttgttacatatgtatacatgtgccatgttggtgtgctgcacccattaactcgtcatttagcattaggtatatctcctaatgctatccctccccccaccccacagcagtccccagtgtgtgatgttccccttcctgtgtccaactgttcgcactgttcaattcccacctatgagtgagaacatgcggtgtttggttttttgtccttgcaatagtttgctgagaatgatggtttccagcttcatccatgtccctacaaaggacatgaactcatcattttttatggctgcatagtatcccatggtgtatatgtgccacattttcttaatccagtctatcattgttgtacatttgggttggttccaagtctttgctattgtgaatagtgccgcaataagcatacatgtgcatgtgtctttatagcagcatgatttataatcctttgggtatatagccagtaatgggatggctgggtcaaatggtatttccagttctagattcctgaggaatcgccacactgacttccacaagggttgaactagtttacagtcccaccaacagtgtaaaagtgttcctatttctccacaacctctccagcacctgttgtctcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatatccttcgcccactttttgatggggttgtttgttttttcttgtaaatttgtttgagtcataatttgttttttgttgttgttttgctattttttgagacagagtctctgttgcccaggctggagtgcaatggcacaatctcagctcactgcaacttctgcctcccaggttcaagtgattgtcctgcctcagtcacccgagtagctgggattagaggcacccaccaccacacccagctaatttttgtatttttagtggagatggggtttcaccatgttggtgagacgagtctcaaactcctgacctcaggtgatccacccgcctcagcctcccaaagtgctgggattacaggcgtgagccgccatgcctgacaggtaatttgtatttctaactgtagattgtagtcaaagtttgaacgggtcagccatgcgcacaatgccagcctgcctacaaatgtagactggggcctttgactcatgcctgtaatcacaatattttgggatgtcgaggcaggcagatcacctgaggtcaggagttcaagaccagtctggccaacatggtgaaaccccatctctactaaaagtacacaaattagctggatgtgttggtccacaccagtaatcccagctactcaaaggctgaggcacaagaatcacttgaacccgggaggtggaggttgcagtgaatcaagatcatgccattgcactgcagcctgggcgacagtgtgagactctgtcccaaaaaaaagaaaaaaaaagagtaggttgggaagccagtaactaggaacaggctccatttaatccatcacaaaaagaggatttgagcagagaaggcaaagacaaacccttgggcaggcagcatctgctctgctggacaagctgttttcaaccatacctaatgatggaagcagggactacattgtccaaagcaaggatcttgggacccagtgggggctcaacgcagcaaagggctgctgatatgctcatctaagatcctgatgggtgcccgtttcttacagaactgtgtgctcacagctgtgctcagtgggccacatggtcctgcccgtctggccagcccatcttggttccactgtgttcctggagtccttactgctaggctctggctgatgctagcccctgtgatgggctgcccgccccacatttcccctggctggtctccactctctcggctactccctgctctgtcccataaaagcactcaaggcagccttctcatctagatcattctttaggcctggagttctttaatctgagggcttttgcacaccctgaattggatgcaaaagggggtatttgtcccatgtgtgtttttctgggaaaaggactcacaattttaccagactctcaaaagcatctgtgccctcagcaaaagccccaagccctgcctcaggaagcctgatctgctcaggctgggtgactatctgtccgtgtctgtcccccccaaagtggcgttcagcaactgatgctggggcaaactgccctgccatctgccagaatgtaaagcatcagctgtgtggaggatgggcggggggctggaccccagccaggccctttcaaaggcactaggggtttggctctagcatgcatccctgttgtgggtggcaaaaaccactaccgggagtcaggctgagctggcttaaatcccagttctgtctctggctcattctgcctccataggcacctgtttaacctctgtgaggctctgatttctcatctagaaaatgccgataagaagatgtaccttccaggattattgtggcaattaaatgagatactgtaagaacagccactttaccgcctataaatgctattttttttaattgactcagtgaaaaacattttaccattttaaataccctcaacccctgaagcactgcagctcttagctctatgacctcaggaaaattacttatttctgtcaactgtcctacttctgacaaatggggatggcttcatgttggtgttcgcaagatgacaagtcaacacgtaggaagcacttgaagcagggcctgggtccttgtacagtcttgcactgttatttctgcaagaaaggagtggcaggtgaagagtccctcccttagactgtgcctaggagcaaaattgccatttctgtctgtcttagtccattttttgttgctataaaggaatacctgaggctgaatactttataaacaaaggaggtttctttggctcacagttctgctgggtggaaggttcaagactgggcctctggtgagggcctcaggctgcttccactcatggcagaaggtgagggggagccggtgtgtgtagagattgcatggtgagagaggaaacaagagggaaagagagtggtgcctagctctttaacaccagctctcacaggagctaatagagtgagaactcactcactacctctaggacagcaccaagccattcatgaggaacttggccccatgacccaagcacctctcaattaggccccacctccaacagtagggttcagttgttcttcctgcctcctgagatggagtcttgctctgtcgccaggctggagtgcagtggcgtgatcttggctcactgtaacctccgcctcccgggttcaagcgattcttctgcctcagcctcccgagtagctgggactacaggcatgtgctaccacggctggctaatttttgtattttcagtagagacggggtttcaccatgttggccaggatggcctcgatcttctgacctcgtgatccgcccacctcagcctcccaaagtcctgggattacagacataagctattgcgcctggcctaggggttcacatttcaacatgaggtttgaggggacagacattcaaactatagcactctctctccttgcctctccttgccgatgggccaccagaaatctctcttcccttcttcaccaaacactgctccacctagacagtggtgcagttgccagaaggcacatgttgcctagcacagaacctcccattctgtccgttttattggcactgtgggctcaaatgctaatgaaacacatggcaagacctcgaattcagtccccatttggttggtgaggaagaggccctactcactgactttgcattcatcacctctgaccccatcacgacctctgagacagagccaagaagcccattttatagatgaagaaaccaagcctgagtggggtaagcacttgcccaaggttacacagctggcaaagggcagtgaggtctgcctagacctcacttgctcctccatgccatgaagctctcttattcacctctttgttagcaaatgtcttaaaagcatttgaagtgcctgaaatgtcaaaatccagctggcatccccattagggagggctcatccactgagtggacagattatggtgacaggtacctgccccggtcttcccacacaccccagcaaggggtcatatgtactctcttccacagattgcacctcccgagttttctctctctcacacctcccttctcaccaccatacccttgacccagtaatttctcagaccctacatgtctccaccagcccacgtgcccattagactcaaggagaggaaacggcagaggttcaacctagcaagcccaagctctgggttttctggctttccctgagtgattgtggcagggggtgggtcactgaaggttatcagcatatcactggcttgaccctgggtgggaggcagggagggcttcccgctttgaggcgccccacccccacccctgtgaacagggtaattatggatagactgggctgagtgatggcctggggtctcgggcatctgcaggctgcccccaggctgaagcatgcctgccagtggcttttaggcccatatgagctggagggtccttccttccttcccaggctcacagaacccctgtggggctgctgtgagtcctgtgaggccacccactaagctgccaccccagccaggcagccttggtaggaacagcccagaccaaagggagattggagccaggaaattccacggtggtgggactggcctgctgtatgcacagattcaggctctaggaggccctgggaagggaagggccctgcccacacccacagtccctcagggcaccccctggctaggcttgtgtttcccccctaagaagacctttacagagcccaggctggagtcctggacgtgggtgcaggaagggaactcagagcttccaggcggggctggcagccacacctctgctgctcctctgccaggccctggcatggcagagccagcctgggcggggaacggcaagaggagcaggaagcagagagagggtttctgtgggggtgtaaccgcccaaggggttctcctcacctgctgcccagatagccgatttatcatgacaggagaattgtaatagagaaagactaattcatgcagagccagctgtatgagagaccagagttttatgattactcaaatttttaagtctccctgaaaattctgagactcaggtttttaaggataatttggtgggtagggagtcggaaagtggggagtgctgattggtggagtcagaaataaaatcatagagtgtcaaagtgggattattttgctgtcttcattcggttcctgggtggcatcgcagaactggttgagccagagtaccggtctgggtgcctgctggtgcattggaacacagggtctgcaaaatagctctagcattaatctgagtttttacaacagtgacgttagccccaggagcagtttggggaggttccaaatcttgcagcccctggctgcgtgactcctaaaccgtaatttctaatattgtgactaatttgttagtccttcaaaggcagactggtccccaggcaagaagccaagaagcggggttgtttcaggaaagggctcttatcatttttgttgcaaagtaaaactataaactaaatttctcccaaaattagttctacctacccccaggaatgaacaaggatcgcttggaggttagaagcaagatggagtccgttaggtcggatctctttcactgccatcattttctcactgttataatttttgcaaagtcattttcagggggaggaggagtttcagtgctggggcttggaatggcctggcatcctgccccaaggagcccaggaacccacctcgggctgcaatgggatcagagctggttcaggggtaagggtcatgtccagaacaccctgggactggcatggaaagccctggaggaatggcagcaagggccatgcgtcagaggcccatatctggccacccattttactcaacatggggccagagtcctgagggcagtgacttgctaagaccacacagaaagaatgggggtgagtgggaggagtagtgtcttccagattgagcctgcggaccagaggcagcctgagggtgtgaaagggccgtggccaaagagcactaaccctgctcaaaggtggccctctttgggccgggtctcaccagcagccagtgagcgctgtggtttccaagcaagctattcggagtgcaagccgtctgaggaggccccacatccaaacacagacacaggcatgagcgcgtgtgtgcattcacacacacacatgagcacgcccatgcacaccccgcaccatgcacacacacatacacacatttcaaccagaagaatttctcttttctctcttctgtatcagattttgatgactgaagccaataaaattgcttttttaaaaaggcagtggccacagaagaatgggcacctttgggagtcagaagccactgcaactccatgtcagggcacttacagctctaagattgctgaggtcaggaagtggcgagccgggttcacataccacacacataactcacaccctctatactacacataccccacacacaaacacacatcacacacacaaccacacacaatacatacaccccacacacacacatcacacacacagccacacatatcacacacaaccacacacatcacatacacataattgcacatgatacacacaccccacacacaaacacacacatcgcacacacaaccacacatgccacacacacaaccacacacatcgcatacacacaatcacacacaatacacataccccacatacaaacacacatatcacacaaccacacacctcacaccacatacacaccacatacatcacataccacacacaccacatataaccatacacatcacatacatcacacaactgcatacaaccacacacaatacacaaccacacatatcacatacatcacagtcacatacacacaaccacacaaaatacacacacccccacacaaacacacaaccacacatatcacacaaccacacacactacacaccacccatacaaccacacacatcgcatacacacaaccacacagaccacacacaaccacacacatcatacaaccacacacacaaccacacaaccacacacgacatgcacaccacacatataccacacaaaccacacagaaccatacacatcttattcatcacacatcaatcacacactacacacaaccacacacactacacacaccctacacacaaatccaaaaccacacacatcataaaaccacacataccacacaccacacaaccacacacatcacatacatacaacacacatataccacacacaccacatacaaccacacacatcacataatcgcatacaataacacactgcacacaaccatacacaatacacacactccacatacctcacacacaaattcacaaccacatacgtcacacacacaaccacacacaccacaaccacacacatcacattcatcatacatcacacaatcacacacaaccacacaccacacacagtgcacacaccccacacacatacacacaccccaaacagtacaccacacgtgaaacacatgccactcacataccctacacaatacaacacacacacaaaatacacacacagcatacacacatcacacacaccacataacacagcacgcactacacacctcacacaccacacataccacacacactctacataatacgtcacacataccacacaacacacacacttccacacaatataccacatacacaccgcacatacaccatactcacatgtgccacacacataccccacatgatatatcacataaacacacacacacttaatttggcatagtcagcaagataagtgagtacagtacctgcacgtgaaattggcatttggaagccccgggatgctcctggggacggaggactgcggggagaagacaatgtgactggggagcaccggccattggggaggagatggtgcgaccggggagaaccaggagtgtttggagggacaccccaagaaacgggtttccatgccctgtgtgatagcaaaggtgctccttagacccatcctgtgctcaatctaggactggagtgccagaaaccagacctaaaggcattggaagggaaatacagagatcctagcacaaggagtgaacagtgaggggaagaaggagcctccgaataggcctggagactggaattgccagcgttacacatttctaaattgtttttctgatgctctctctaagaggggaggcactatcactcttggataaaggcacagtgttacaatgtccttctgatggcacacttgcccaccttagctttaacctcacagaaggtgtgcttctgccaattgctatgcattgaccagcagtcatagtggagctgacaccaaggagctgttttctttgcctctgattccttctcaaaattgcaccaaatatttgccatggcttctggctggaagtaggaatgttgttctgaacaatattatggggtggcggtgagatggacttgagaggcatcccggactcatgactcatctctttccctgcatccccagaatcctgtcacattactcttaatggtccagaaaatacaaggactcctcgaaggatgaaagaagggatttggtgagcagaggaaactataacccacactgtgtgcagtggaggaccagtgagaaagtgtggggggcttatggagtgcttccagcagggaagaggcacgtagaaggagcagagggccctggagccacagcaggcaaacctcttgggaatatgagacaaaatactacacatacgaaaccacatttgttcattctccttgccagcagaattttacgaagcccctgactcagtggctgagtgcagccctccagaagaatgccctgaagatgataagcaggatagagcacaggctgccatctctcttgcctaaatcactacattttaagaaaaagataagttcaatgatcctagcttttgcctcttcttgtacataagacaatgttcaagaggattagagattatgcttctataatctataaccaggtgcacccaaacattgaggagattctgctctaatgtaacttctgagcacatgcaaaacctccactgccagtatagaagctgtgggctgccacattgctttggagcagtctagcagaagttctgtgaaaggctctcctgggttgcaatcctcagtgagacttctgaataaaactaactttaattatcgaaaagcctgatttttttctttcattgacaggaaccagagttgagattgttggctctgtcctccttcacccagcagcaggcaactttgggagcgggcacttgagtaggagtgtgaaggtagccccagaagcactggggacctcccatgcatagaacactaactactggcacactcagcccagtagaattctctccacctccccagccctggagacagccttcactgcttgcaggtaacaaagataatgctcactgaaggatctcagagaaccttaggtcaaagacaggtattcaaacaagacataaacaattgtgaaaaaagtcacaattgaataccagcaccaaggaaatagagttaattgaatgaagagattttatttatttatttatttatttatttatttatttttactttttgagatgaaatctctctctggcgcccaggctggagttcagtggcgcgatctcggctcactgcaacctctgtctcccgggttcaagcgattgtcctacctcagcctcccgagtagctgggattataggcgcagcaccaccatgcccggctaatttttgtatttgcagtagagacggggtttcaccatgttggccaggctggtctcaaactcctgatctcaagtgatctgcctgactcggcctcccaaagtgctgggattacaggcgtgatccactgtgcccagcctgaagaagagattttagaagaaggaaatatctcaagaggaatgaaagtatatcaagaacaagtgattatagaaatgaaataattagatcttggcaatgaaagatatgattgtcaaaataaactaaataacttaatgattaggattagtatcatgataacatacatagagaattagtgatgtagaagaacaaggcaagggatactccagaattcagtgcaaaaagatagaaaggctgctagtggtctaccagattccagtttcctcttctttcagagtacaaggctggactacatgcaggttgatatggccacgtggctaaattctgtccaatgaatgtgagtagggggtctgtgtgctgctgatgaactaagggcgtgccttctccctgctgtcctgcttcccactgcctatagccagctctgcaagcaggtgaggatggcacactagagatgtcagagaaatggaatggagggagatttgagcttgtcaatgtcaaataaaagataaaataaaagattagagatgaatgtctaatgaatgtctaaatttaaaacattttatttggaagcaagaattgcaaattggggcatacacacagagtgggtagtcttaggtctgttcaaagaacaaagaaaagatgggaggttttacaaaaaggataaatgttatgtatcatttgaaagaaagttattttgcattagtaaagttttggagagctggtggctctgactagtgagggatggtggtgggtagagtcacagcagattgttttagtagctgttagataaaactggtttcaggttacaacaggaagcttcagcagttgagcttgtgaaaaatgtaattcttggagcaggtgccatgtgcctcaagtaattttcccccccgggcccttcaatttggatttagtcaggtgtaataggaatggcccaatttgcataatcttctttcttatggctcccttttgatcaagatctttctccaaaaccattgctgatcaaccatactgtcttgggaaaagctgtctatcccatgaaaaacatcaatttctcattctggtgtgcagtttgaatgcctctggttatggcatcaggccttttggtgaactttctgtgtggcacatacatcagtcatgagacatgttccttaaaatttgtctactttcagctttagaaatagaacagttcatgttttggtaattttatgagggaaagttggattagaggaacccagaagaatttaggtctatactagtctataggtaaatagcaagaactcaaacacaatgtagagttatcatttattaagaggcatattataactttactttagaaacacaggttttaaaatttttaacattgatcacgtaagaacctcagatttaaaactttgagactgggaagccaaactgaggcagactttagattttgcttacagttttaaggttcctgtgccaggaaatgacaattttaatgtactcattgtaaggctggtaacccttgaagtcaggcattttgtgcattcttcaaatatgacattttagtcaaagccttggtaatataatcaattatattctgctatagaaagagaatggattttttttttttttttttttttttttttttttttttttagatgtggtctcgctctgtctcccaggctcactctcccaggaatgcagtggcatgatcttggctcactgcaatctctgcctctcaggttcaatcaattcctgtgcctcagcctcccgagtagctgggattacaagtgtgaaccacaatgatcagctaatttttgtatttttttttagtatagatggagttttgccatgttggccaggtgggtcttgagctcctgacctcaggtgatccgcccgccttggcctcccaaagtgctgggattacaggcacgagccattgtgccccgctgaagagaatggattttcattgcacttaggcaaataatcatattgccataagaatactcacaaatagtttttgaattctggaagaatcaagtaaggagaaaacaccaaatgcttttatctttgtttaaaaaagtatactttatcaaattgctgtaaattatagataaagagaaattttttccttaaatctggagaacaaaatatttaagacaagaatcaacaatgttttaaataaaagttataaaaatattatttttttttgagatagagtctcgtttggtcacccaggctgaagtgcagtggcatgatctcagctcattataacctccgcctcctgggttcaaactattctcctgcctcagcctcctgagtaactggaattacaggtgctcaccaccactgttcctctgttgcccaggccagagtgcagtggcacgatctcagctcactgcaagctctgcctcctgggttcacaccattctcctgcctcagcctcccaaataggtgggactacaggtgcccaccaccacgcctggctaattttttgtatttttagtagagatggggtttcactgtgttagccaggatggtcttgatctcctgacgtcgtgatccacccatctcggcctcccaaagtgctgggcgtgagccaccatgcctggccaaaaatatctttatcaattacttaattcatgtaattaatttttgtcctgattgatcttgattactagtttcatgaacccatcaatttatttagtagagatctggacatttttatttagtctattgatcttaaagttaacagaaacctgtatttaagagtatttattagaatcttttccattaatctgattgtaaatgtttttagagaagaattcaaaactgtggatgacaaaaacttagaatagccatagttaaaaatctgacgaaagtttataatcaacaaggaaatttcgttatttctattatatatagcattttaagataaccagaattatgactaagacatatttctataaatttgtttatacttttttctttttttctcatctgatatttttataaatttacagaattttcagaactttcatatcaacaacataccaataaatgcaactaaaagaagatctagtatcacttatcatttgacaatgttttttgtatgatttaccaaataacagtaatcatttaatatccccatctacaagatgagaggtatatctcttgagactttccagggaccaaattagaaaaatcccaaggttaattctaggtcatgaagacttaggttaggatttgattttggggaagtttgtcaatgatgtaaaaaacttaaaatatttgattgaaacagaatcacagatcactgaaaaataatagtcattcacttaactaaagcgatagttgaggtttcagaagcaatatagaaagttacatggatgtaaacaccttaacctttttcaatatcagtttttctaagtaatcaaaaacctaataaagacaacacaataaattatcttgataaaatggttttttttttttttggctcagtaaccaaaaagttaaaaagaaaatctgcagaatgactgtttctccttaccagaatctcactaatataacctggaagttgaacctaatgaaaaatatacttgattttaatcctacacaggaagaatatgtccaagattgtgagtatacactatattatagaagaatgtaaacaagaaaactagtaccttgagaaagaaaatacatggctcttagtaacagcatggaaaagcttcctggttacatggtacaattcagacatattgagaaaagccaagagtatagaatcaaattatactggaggaaaacattgcttttctaggcttttaagagaaacacttcagcatcagaccataatagcagaggtagaactggcgggaaaaaaaaaagatgtaagagttgacaaaaaaggttgaaggagagaattatcaccccagccaagcaaaaaatacaccttttcaaggggagaaagttcagaaggcaaggatcttttgctgcaagtcatgtgctgcaaggtacagcagaagttgaacttctgagacaaaaatttgagaaatttcaaaaggaaaactttacctcaaggaatgaattaccattgtaaataaagaggaccatatttttaagccaaaactagggaaattaattagatctcaggaaatgtggcagatactgacactggctgcagtttagaagattgttgttaaaaaaaaacagattttagaattaaaaataaaacccttttgcaattttattaagagcagaccaatacttcaaaaaaactttgttgttctaaatagggggccacatttttttggtttagtattagtgtatttttagtatcaaattttaatctttagaaacatttataaataattcccttctaattataaacaacttgatcatacacaaaatttatttcataacttccccctttatgaacctttttatgacttacttggaccatagttgacatacttgttttttttgcttttttctatacatcctgtttcttaaataactagtcgttttgctttaggacaacaatttaccacataagagtctttctcaaataaattatttttttcatattacttatattttgattaataaacctaaatatatttagtattattataaaattgaagaagccaagaacaaacttatatttatttagcaatttgttggttttttcttatttggatatgaaccggacatttaatgagtacctattatttaatttaccataactttaagattttagattacatgaaaagtttatttataaatgtttattctatttatagtcacctaatctttttaacaattatatctagagtttatatgtataatcatctaattttttttaacaactatatctagagtttactatgaaaattgaggtattagagctagtcattaagttcttttattagccaacttggtagcctgttaatatcaagtgtttacctaagtaagagccttaaagttaaataaatgggtatttggttgataactcacaagctatagctgtttttattgaatcaacaatattaaaataatcttacttatcaaagaattgcacaaaaatcattctgttttaggctgggttcacagctttataaccttaaaggatctaacagaagcaaataaactgtctaatcagttcacccaggcaaaaaatatatgttgacaattttgggacatttctaattttatgttatcaacaattttgaagccaattaatatatccaatatttacttaagtcatgtgaacgaaaaaaatttttgttcattgctgtatattttatatgagtgctcatttatctaaatagaattctttaaggaatttttggccagctatgccagattttgccatgtagacacaacataaaacacaatacatgtacatatgtgtaaacacatctaaacacatatacacacacaccaagatcttacagcatcagcagtaagcaaataactgtggaaatgactttaaataggcgtagttaaaaacagaattgacaagaaaatttggttatttctgtggtttacaataacttaacataataactatgattgatagcatatactcagacatattagaattttagaaaccccatataattttggaacatatattaatatcattcactaaaatatagcctgaagaaggttaaacattagtttttattttgacaatgcttctcatgtaacttaacatgtcaaataatcctgttaacctctcttttggatgcttcaggggccctctgtagcacctcaaagttagaggtcagaaaagacaattttgaagctgaaatttgattttgggaagcttatcaaatatgttattaaggtttaaaacacttaatattatgaaatagaatcccaggtcaacataagtcattcatttagccaaaatgatgactcaaaaatataaaaggcataaacctttactcattgatggagggaagacttagctttccaaacaatctgtctcgtctttcccttctttttttggtagtttattcaaaaggcaaacaaaaatgtttcatttttaaaaatatagcataaaaatcttgttcaagagagaaagccaattttagcattgcattagtgcattattgatgtcaaaccccattcttaataaaaccttatagacaaatatgttcaattttaatgtctgactataagataagattctcataagtcttttttataaccctttaccatttttgttaaagagcagatcagtgctctaaggaaactgttgtggttttattccaatgttcaatttacagaaaaaactgagtaatacccctttaaatttagccaatatgttcatacatagaatctctgttacaattaatttttcacaactgtttcacaacttgttcaaacctttagctttatcctaatttaaaacaatactttaaccctctaaactaggcaaaaatttacatttccatgccttgttataatcttttagtaaaagcacattttgctttcctcatacactttgcatgtacaactttttttagtagtcttaattacatgttacaatgttaattcttagcaatattaatttttggtgaaaaccctgttaagtaagtgattttaattacgtactaggtttggagcctaggacaccagacagaagtacagataaggtctgacccttttcagcatagctaggggagtggttaattccacatgtccttaggtctgacctagctgttaagcaggcaagttgaacaattttcaaaagccaaagaagcagtttatgaccttaaagcatttagtaaacctaatatctgacctacctaatttatttacttattttattttattattattttttttgagatggagtcttgctctgccgcccaggctggagtgcagtgttgcgatcctggctcactgcaacctccacctcccgggctcaagcaattctcctgcctcagcctcctgagtagctgggattacaagcatgtgccaccatgtccggctaatttttgtatttttagtagagatggggctttaccgcgttggccaggctggtcttgaactcctgactccagggatctgcctgccttggcttcccaaagtgctgtgattatgagcatgagccactgcacccagcctgacctacctaatttagaccaaatgtctttattttaccagtaatctttaaaactgtttttatttctcagagattactaaagtcacgtgaactacaaggcattacagttttttctttcaaaatattttatttaagccttatttttctttaagccaattacttagagttcatttatataaacatcacacacacgacacatatataactacacagatagaaaaagatccactagttgtaagatttttcatttgccagtttttaagtttcttaattagattactggcttcagggtggggtccttcaaggagcagggccaggaaaggatgcggtttctaggacctaataaggaggcacaactgaatgacaaaaacagatctccaaaattaagggtcccatttttatattacatcccagatccctaaaaagaggaaaatgctatagaagacagtgcaatgcttttaccatgcatttaattgcatggcaacccaaagccaatcagcccattttgcaatcagcctgtcccccgtgagagtcaattaatttgactcctagtagggggtggggatttttccgtaccttctaggtggccaagagcatgcttctctgattcaagcatggttagtatccccccataactgccattaaccatctctaaaagtatatttcctacctagttattacacacgaaagttctcttataatgcaagtaatttttgatacccccaaaactgaaaaccttcagataacacaatgcaaaatctatttactttcaattcctggggtttcatgaggaaaatcgagattttttcccaaaaccgggtctatggcacttcctctgtttttcctaaggagtcccagactattggaagttatcttaggtcttctcatgtgtgcattaagtgtggcaagaagacaaaatggagaaaaacaattcagttgactgagaagaaaaaacaaacaaacctattttcttcagaaaaataagatccaagaagggaataaaaacccataaaggccatttaaatatacatatagcttggatatatgtatccaagtcagctttaattaaactgacttttaaccacagcactcacaaaaatgttcttttaatttctcattactctagtttagccagggcaaacagccaatatatctggcttttaaactttaccgtaagtaactctacgagtgaaaccaacaaacctcaactaaggttatgacttaaccatgagtgtatgaggtattttcaatttttacaaaattaagaatcttcaaaggtagctcagagaaaggaaaatttaagaagggaagccagaagttgttaatggaggggaagggaatcaacaaacggtaaaggtcacagagatgtccaccagaatgtactcattctgtaagctaggatagaacccaggctgccattataaaatggcaaacccttagctgctgagctaaaacattgggcagtttccactgcttttcccacaaagagtctagagcaatcaattttgagcttgcaatggcttttaactactcaaaataatttttagagctaactatgatatgagccccaaaattccttttccctagatggcagagaccaagagaaagtactgccacactgttacaaggtcaagctcccaaggacataaaacaagatggagacctcattcagttttctgcttgtttcaggaatctgtagcaaagtttgtaaccataggcaaaagcctctcaattttgcaagttgccacccaactagctgcatggaggacccaaattaatgttttccattctggccagagaaaaatacatgtgacaaaacatagacattagccactctgcttagcacccactatcgaacttgtgaggctcaaacttgcccccagttggtccctatcatctttaatacattcaaagtggattaaaggagtttcaacatgtgatctttgggcaagatggacgcccttttaacagaaaagaaagggaaagaagagaaagggagaaaagcattgcctgtggcagagtggggaagatgaggagctcagggaggccagagaaagacccacccattgcagggatgctgaatcaaaagttcaggcggctgattgttggtcgtgaaggatcttttcgagcagtcccatcagctcccaaattttcccctttggggagaaaaagttccccacgttctatggcctggtacacgcctaatcctatcacccactggtgttagcaaagagtgcaaggcagatcactccaaagagaatagtggttaaccccatggtgccaaatccacgtttaacaaagagggactttactgagggggaaggcctccaacccaatcccatcctttaccaggtaaaatgaacccactactcacccaaagtcagcccattggtgctgcggtctatttcctttggatcgggatcgtaactaagctaaaaggctagcagatttaattttttaagtcaatgagtcgcataagctttcgatttgccttttgtaaagtctttaaataaaaatactgaaatctttttagaagcttctgcatatcaatagacatccctagatgagactaacttgggagccctcattttcaaatgcacttcagtgcagttttgttcatttggaacattccactctaagttatctttagtaagatttcaccatttctataagactgctgcttccggggcctaccacttatgcaggtattagccagaaggaactcagttcttcagaaattaaggatccaggccgggcgcggtggctcatgcttgtaatcccagcactttgggaggcgaggtgggtggatcacgaggtcaggagatcgagaccatcctggctaacacggtgaaaccccgtctctactaaaaatacaaaaaaaattagccgggcgtggtggcgggtgcttgtagtcccagctacttgggaggctgaggcaggagaatggcgtgaacccgggaggcggagcttgcagtgagccgagatcacgccactgcacttcagcctgggcgacagagcgagactccgtctcaaattaaagaaaaaaaagaaattaaggattcaatttttacctcagattttggctttgctctcaggttcctttgatcaacctagccaatgatttttctcctaccaaagtgcataagaaaaatgaaacaaggccgggtgcagtggctcacacttgttatcccagctctttgggaggccgaggcgggtggatcacctgaggtcaggagttcaagaccagcctggccaacatggtgaaaccccatctctactaaaaatacaaaaaattagcagggcgtggtggtagacgcctgtaatcccagctcctcaggaggctgaggcaggagaatcacttgaatctgggaggcagagagtgcagtgagctgagattgcgccactgcactccagcctgggcaacaaggtgagactgtctcaaaaaaaaaaaaaaaaaaagaaaaagaaacaaaggggtaaaacacaaaaatccctgtgaattttcaatagcctaattttacacccctgcaatattaccatttactacgtttctttctgacccagtcagatgtaagaggcctctaactgtatccaagccagttaattaccagatcaaatccattccttgaaccagcccagtttctgtcatgacttccaaacccagtttggaacagaaatttgctcaaagaaactcggagagctcaaaacacaaatcagtggagctctgacattggagagaaaacttaccatgacttccaactgctctgagagatcaacgaacacaaataggtcctgcaggtacctggcttcagtcactcagcactcctgggagtcgttagaagctctacttcagatctgctctgacaccatctgataaaagaaaaacttcagctgaattaaatttaaaggagcttaagtgagcaggcaatgaatgattcgcgaactgggcagccttctgagccagagtaggctcagagactccagcacagccacgtgatggaggaagatttatggacagagaaaggaaagtgaggtacagaaaacggaggtgaggtacagaaatagctgattggttacagcttggtgttcaccttatttgaacagggttcaaacagttggctacatttgattggccaaaactcattgattagcacaagtgtagactacagtctgtttacacctccacttgttatagttcatgatgtacagaaaaacctttaggctgaacttaaaatatgtaaggaggcagatttaggctaaattgatttattttttattatatttttaagacggagtctcactctgtcactcaggctggagtgcagtggcgtgatctcggctcatcacaacctccatctcctgggtttaagcgattctcctgcctcagcctcccaagtaggtgggactacaggtgtgtgccaccattcctggctattttttgtatttttagtagagatggggtttcaccatgttggccaagctggtttcaaactcctggcctcaggtaatccacctgccttagcctcccaaagtgctgggattagaggtgtgagccaccgcacccggccggctaaacttgatttaacagtacctttggggagataatttttttgtataatggaatagttactctaattataagctgctattatacctcatttggatctgggaattttctcatgtgatgtatgtacacacacacacacacacacacacgactaatattgcaatattcttttttgtctatgtttgtgtgtccttgtagaactttctatagcccagtctggaagtgtagggaaactgtatctgtttcagagtgaaactgctctaggggatgggaaattttgagtttattatttccatgagaaaatggaatggggcttcttttgggggaagatttaaaattatctgtggaaaaaagtgagttggacttggtaatgtaagatgagaaatttttcattattatattcaatgagatagacacaaatactggtttccttaatatttctgaaattgtatcattgactatgatagatgagactactgttcaaacatattcactcttctacctctccatttcactggaagagtgtagttactggttctattaatgttgggcatggctctgacttgctttggcctcagggtaggtgggggacagttctttgcctctcgactgtgctcagccatgtagcttgctttggtcaatggatgttagcagatgtgactcacggaggaatggaaattaccttgcatagctgggcttgtcctcttgaactgctgccatctccatgcataacacttctttgaactccttcagcctgagccccagatggaatatcagtggagaagtttaaatctcagtgaggagccaagtccagttggactcatagcttgaaacagagctgccccattgagctcgcctaggtcagctagccccagctgacctgcagtcatgtcaattgtatgtcactaagattttgtggctcttttttactcagctttagctaactaatatatcaccatatcagggaattttggtaggacaacatagctaagcacaatttgagatggggaatagaatagggtaaattctctgttcaaagcatatggtaatctggtgcctattttacttattatcccatttgtgcccttttttataacatgtctttggaagcgaaactgtacatccagtgtctctgtaacactgagtctattgtccatgtaacattcagtctactgaactgctttaaaatattagttgaatgacagtagactgaacgaatctctgtagttccagaaggcagggagaaggattgggagagtcgacacaaagtgtgcagccagggctgcgttggtatttttcctctgatgtgctccacagaatggcagctgacccactgtgggttgataatttcactggttcacagaagacagggaatataggactttagggaaataatgtgcctttgtctttgtctttctcttattctctatcaagggggaaaatgctgctctgggctggttggattcaagctcatggattggaccatgggataaagttttagtggcagatggctacttccttgaaatagagtggagaaaaagggtggcagcattggtgagaagggacaggcaggaggcagtagggaagtccagctttactctggagagaagaagaggtgggggtggggagggcagggccagctgtttggggtgggaggcagggaaggtgttggctgcccagttgacatctcttatctctttcctggggccagagtaggttattttacagcccagcctctttatggcctcagcagagaagcaaaggcaaacaaagaacaggtgatccctcagggcccaaggagacgcctcctacagcaggtgtgcccacttcagcagccctgctggccagaatctctacttagaaggcttctcggaaggccaggcccttatcggcttccgactttgaagtcctaggaaccctccctcacacctcccttctatgtggctttgaaaatactttgatattctatccctatcccttaattatttgaaccctcaccagtttgtaatgagcctgaacccatctttgctccattttacatatgacaaaactgaggctggaagcgttgttgccaagcttctttgccctttgtaccatgggatttaattacatatattttatggattctttcctttataaagttgtaatcattcattcttttttaatagagagaaatttagaaaaggaaacaaagcaaaaaatgacctaaaatcctatgggtcagataactcccgttgatattctttccttctttcccccagttctatttccagaggttaccactttcaatttttatttctgtttcattctataaagatgaagaaaatttttgacacctttaaaaatataatttaaatcatcttaaacttatagaaaagttgaaagtgaggataaagaacattaatttttctacgccatttgagagcatgatcccggcaatttgcatgaacaccttgctaccgcctcatctgcaggctccactaaagtttcatcagctgtcccaagatacacaggtttcattctcctgtctctggtctccttcaatctggaatggttctcccttctttccttgacttccatggccttatgtttccagatgacaggccagttattctgtagtgtgtccctcacctgggttgaggctgatgcttcttcagggttggattcacttgcatgcaccttcagcaggaagatcacagaagctgtgctgcgttttccttgcatcctgtcatgtggtgagtaatttcactctaggattagagatggtgttcgctatgatcatttgattacagaggtgactgccagccttctccactgtaaggtgactcttctctttgtaataaacaaatattttgtgatgaggcacactgaaaccatgaatatattccattcctcatcaaactgtcactttactccatcatttagttatattgaaatggactcagatttttattttattcagtaggttattatccatcatcattattatttactttgatgctcacatggtcgaagatttggccatcaagggccccttcaagccaggttctgggcttttctggcctgcacccttcattcttagagtacttcattactttctagctcccaagatctttcaggtttatcttgggctttcccagcccttgccctggaatcagccattttccgaaggagacttggattcttttaatggagaatggcatttagaagtcaatatatgggtgctaggagtgttcattgctattggggtatcactgctcctagactctctcagtggacagagcaaggatatatatgcacacacactattagatcaatatttatctctctatatagaaaaccatgagctcacttcaatactttcaattctaatcaaaaccacagggcttattctgggtttccctccttccatattcatgactgccttctccatgagtgagaaaactggctcccaactttgctcagttggtccccctgcatatacccaatcttccatagcagaactctgcccctccactcattctgtgtggctctgacatccacacttggttgtccccttctgccatgtggactttcatttgacagtacttggactctaacaccctgtgctaggccaccgtgcccctgcctccctgcatggccactctttgtcctattctggctctgacatgccatgccaggctcccccacgccagatgggtgccatctggtacatatcccgtgtgcttagcttagactacccgggctatgatggctactgtcccacccatgcccatgtgctgcatgcatcttatgaaggcatctggtttattctccctgctcatcagttcaatcagcatgtgctaccagtgtagtgcaccagcataccatctgtggatctgtgggatgttcagaagatcaaggtctctgtagaccacactataacagaaagctggaaaacgaacatgatctgggagaagacactgactttgtacttctatccttgccaggtgaaagcaaacttctgctggttcttaccgatatagatggggagaaaacacaagctgagtcaatagctacatattaagtgctgagagtggttaagttgttctatgttgcatttagaaaagcagctaaaattggagttactgcctgattaaatttacgacgacatacagtcattctccaagattcagcaacttcctgcacaggctaaagagctaaagaggtgagccaagtgggcagaaatgtgacaggcctccctgtccctgcatctttcatgtctttaatcatggcatcgatccctgtaattcccctagaaatacagaaatgcaggtttactatttgcgtagggaaagaaaatcccaggctcctgggcctgttcaaccatttctttgacctcatctctccttgcttgattttataccagttgtgctggagtaccttctaatatggtttggctctgtgtccccacccaaatctcatctctaattgtcatctccacatgccgagggaggtacctggtgggaggtaatcggattatgggggcagtttacctcatgctgttctcatgatggtaagtttccacgagatctgatggtttaaaagtgtttgggagtccctagcctctctcctgccgccatgtaagatgtaccttgcttccccctctgccatggttgtaagttttctgaggcctccccagccatgtggaactgcgagtcaattaaagctgttttgtttataaatcacccagtcttaggtagttctttatagcagtgtgaaaatggactaatacacttccttaatgaactctctcagaaaggattcaggaaatgtaagcttgcaagtttagaaatatccttattctacctttacacttgatattatcgctgagataagcgttttaggttcaaaatatatttccaggagtcctaaaaatatagctccatcttttcagagtcttccatcatcctatgttgttgacaagactgagaatggtctctgtctctcctttcctttgtaggcaacctttctcttcctgctcccacccatggaacattttagaatcttcttttttttttttttttttttttttttggtgttttgaaattttgcagtacctgtctaggtgtggagcagttccccgggcttccttttaatctgtagctctggaatactcttgctattgatgattctatgtgtcgactattttgctcacaccccacccagatgcattctctactgtggttctctgctcttccctgtgccaggggaagctgatggctcctttgctggcagggctccagttgggtttggtcaatgggagggactgacaggagactggaagtggaaggagagagaggttggtagaattcttttctacttccccttgcttccatgctgtctggaggcggtggcatgcctccacactacagaagctcccactgggggcccttcctctgcagtcctctggctgtggtaatgtggttttctccttttgttcttttaactgtagggtggtgattgcttctgtcttctgccagtctctgggtgcctcaccatttcttgtttctttcctttaacgcttcccacacctctgtaagttacctttttattaaaatccctttgtttgacaatctgggggtgaattatgtgtcctgtgcagactatgactgatatgctgcctttcattgtcttgatttttccttcctggaaattttagtaattggatgatgggtcattagtgttaatcatccatgtctcttattttagctctgaagttttccatctttctgtgtttttgctctacattatgggatatttcctaagctggttctcccatcccttctaatgatgtgttttcaaatttcagtagtcatgcttagttttcaaggattctttcttgctttcttagtctgtcttatttcacggcaatctgctcttgttatatggattcagtaatttctctaatttaggcattaaaggaagttttggtctcttaaagttattttctattccctaagttatttcagcttcttttggggtcagttattttgtttattcatcttgacctatctcctttgtgctgttgattttctaaatgtgtgaggatctttggttctctgttataagtactggaaaataaactggtttccccggatagctgatgtggcttccctctgctatagccttccatgaaaaaagtaggacagcttccgggagctagctatatgtgagtggaccatgcttggcagctgcccttcagaatgcacaggttgcgggcagggatggccaaggacatttctcagggagctgtgtgtatgggatgggtctctgagaatggagagcttgatgagttcaggccgtggaagcaacatctacacaagcctggatctgagaaactcaaccatactccctgaaaatggagagtttacatgcagaatgagtctgggggaggcagcactagaagggctgaaagaggaagagagtcagactgatttcagagggacccatcctagagggaccactgccatgactccatggggacatttccaaggggagccacaggaggtttcactggagagttgtgtatgtctgtccagtgtctaggaggtgctcaccatggctgagcttgcagggcctcttaggactgtccaggtgagatgtgtgggtcgtgatgagggtttggagaggtttccagctagaattggtcgggacagcccattagctctggggcagaggctcagggaggtgggcaagcatgcaggacacaggaatgcttatagccacagctctgcagggtgtttcttgcccataactgtgtggagagccattctcatctcaactcatttcttgccacaacatctcccgaagcaaactttgttattagctccgctttgcagatgagaatctggggcaatgcgagacggcttctgtgcccggcttgtgaccagtcaccacactgactctcaatgtggtgtaagcaactgtgaatgggcctgattccaaatcccagcaaatttacagtaaggagggtgcctggggtctatccatcccctgactagctgatcttcagcttcctcataggaccagggggaatactgagcatgcagtggactgaggttcagagaggtaatgtggagcgctgcacacacctgagggagttgtgcgcctgtctgacttccgggtgattcatgaggaacattcctgatggggtgggaagggaacctgtcactaagctatttaggagaatcagtctccagcaggtcacaccagccagccacttttatggcagaaggaaaatcctacctagccccttccccagagatggcagaatgcagcctggctgactggcagagcctctcaggctgtgctccggaccctggactccagcaagggggaagaacagcagctcccagttctttcttacagactgctttcttgaggagcttcaagtgctctggctatgattggtgcagggctctgctgcctccagagggtgctgtctcctttccctagcagaggcaaagggtctggcaggcaactctgggagtattggtttaacctgaaatgtctgctaggaagagctacctacccctctcctgggcattatggtcctgaaggaagagcttggactttggattgaaagtccagccctaccatctacaagttggctggctgagacaagacactctacttctttgaggctcagttttctcgcctgtgagatgggatgatcacaccacaccagttaggcatgaggatggactaagggcaggttcacatgcttctgcctggcatgggagctgtttgctgcttttaccaccatttcagctcttctgctgttctctgacccacaagagctagggttcaggctgcgtgccttgcgcagtagttctcaaatgtgtctatgtggaagcttgcctccaagggcttaccagcaaatccagaccccacacagctgccctgcaagaaggaggtgacagtggctgcgttcttgcctgcacagaggacgggtgtccatagagctcccagctggagttgagcagtttctggtcaagcaatgttctctgattttacatgtctggaagctaccattacaatcaggtcttcttaaatgtcctccctccctccgtcttcctttcttcctttctttctttgtcagatgctgtgtgtggacttgtgctgggatctggaggcggagacaagagctgtgacctagacataggggagtggggaacaaaggtgctcaggcagacaaccaactaggctgctacatctgcctctgcagcagagcatgggagggtggtaggaatttgtcatggcagcagggacatcggagctggggtgcaacagaggagcagccgctttccaggtagtcaagacaggaagcagcatggtccagaaagaagagatgacaggtgccagtctacagcgatggtgagcagaggcctgggggcttggcaggtgggttcgcatcctggatctggctgtttcttagctgagtgactttgggcaagttgctcaaccactgagtgtcactttgcttcatcagcacgatgggaataaaaatgcccacctctcagagctgttgtgatgattaactaaggtagtgtctgcagagtctatgcactacaaacggcagctgccattctagagggaccactgccatgacttcatggggacatttccatggggagccacaggaggttcactggacaggtgtgtatgtccagtgtttaggaggtgctcttgaagcagatctgttactctcaggaggttctctaagcacatatgtgactttgccatgtggggatggggggcagggaattataagctagtgtattcaaaacaggagcagcccttgtaagcaaagctgttccattatagccaagtcatgtgcatctcagctccaaaggagaaagtgaccattctcattgaattctcatcgccacaaccttgggactgcctgagataagacactccacttccagggcccaccctgagttttcactcacaccctggatgcccatctccttccctcaccctggctgacattctcagccacactgccctcccctggtctccaggggctgaatgctcccagcctcagggcttttgccgtggctgtgccatccatctggcctatcgaacccatttgctcacagcatctcaccccctgtaataatttatttccctctttccttgtaccctgtctgtcttctcccccagggctgagagctccagaaggaaccaaggacagggagcctgtcttgtccagctctggtgcccagcaggagagccaggctcataggaggtctgcaagtaatgtttctggacgaacttatgaaaggcaggtctttttatacccatttcatggatgaggaaactgaggcagagagagagagagacaggcagacgcacacacccctagacagagagaaacactcctggagaaagagaaagggagggagagagggagggggagggagggagagagagagagagagagagagagaaagaaagaaagaaagaaagaaagaaagaaagaaagaaagaaagaaagaaagaaagagagagagaaagacagcgcagctccagcctgcctgtatccagggttgaggtgggcgtgagagacacacgcaggcagggctgcagttccgggcaggccttgggggctcaagatgcggctccccagggcgagtgctggggtcccggggcaggcgggcggctggagcgctctcgtgggcgggcgcaaggggcaggctgggcgggcgcaggcgggagcgtagcagccgctccactccgcacgcaggcagcatcggggcagcaggagcaggtgaagcaggcgcggctctgccccgcgcctggtgccccctgggcacaggagtgcggccgggggcggggccgagtgggccccggtacgaaccctccgggaagccgggcgcgctgcctgcccttggcccggggcgcagagcgtcacactggatctggggagcatcctacccccactgtggacctcagtctcctcacctgagacatgggcggccccatccgcaccctgtaagccgcaagccaaggaggtaaggggtgcatctgaggtgtctgggcgctatgggcattaggatatagtagcttttgctgagatttcaggagacaaagcaaagggccttccctattctaaccccactgggagattagcattttgtgtatgattcattaattttcctctgattgactgggaaggcaggctgcagggggtccctgttggggcttgcagctggttctagtttttgtatctggagagctgcctggggacaaaatgcagagacaccattttattgaccttgcgtaataatctaccctccccctcatacactcgccacccccttgggtgtgcctgagggacttgaggtcccctggtcctcactggtcagtgtaccccaagcccagcagccccaggcagatgcccaacaccaccttttcagtgctcctcctcctcctgtcttggccctctctgccaatccattttctatatccaagtgatcttactggaatggacctgaccttgctggtctggcccaccactccagcttcatcatctgccaccctggaacctcttattctgcttacttttcccagcaggctctgctccttcctgcctctgtgcctttgcacatgctgttccttgcacttcgagttccctcctctccctgtccctttggctggttgactcctcttcagcctttgagccctgtaccattgccacctcttctctcacctccctgctccctgctccttctctgatctctcaactcacaggcctctctttcatattggtgttggcaatggcaatgagttccatctgcattcgtgctggtcagcccctctgctctgggagggccatgactgtataagtcatctttgcagcccttgtttctagcccagggcttgacacacacttattgagtgggtgaatgaagcagtgagcattttctggagccctcccagcccagtccttccactctgatcctgctttaggtggttggtttgggatgaatggtgtttctccacaccactggccaagccttgctgatggtcacccagagccttgggttctggcccatttgctgcttctgagtgcagtgcctctgccacaggttcatgcagctgggactgctctttatcttatattgggccctgtgtttggctctggaatagtttattttgccatgttcagccccaaatggccctttttgccagaagaccatagtgctggagaaatcttcctgccttcgagatctggttcctaaataaccagactgtaaactatcaggtgaattcacagcttgatcttttaaatgaccaaatgagactcttttttttttttttttttgagacagagtctcgctctgttgcccaggctggagtgcagtggtgcactctctgctgactgcaacctccgcctcccaggttcaagtgattctcctgcttcagcctcccatgtagctgggactacaggcatgcaccaccacacttggctaatttttgtattttcagcggagacggggtttcaccatgttgaccaggcaggtgttgaagtcctgacctcagaaactcatctttataagtagatcagatgcacagcgagtgacattcatgacagccgacaaatagagtttactgagctctggttgattttggccttgtgctctgcaaaaactgccttaacatagcaattgatcatgtaaaaaatacatatggccatgatatgagacttaaagaatatctcgaatagggttttctgctatagtgttttacaagatggggtccaagggccatgtgcatcagaatcacatagtctacttgttaaatacagattcctggcccccatcctggattcacttaactacatctcctggtggaagggccctgggatctgcactttcaacatgcttctagaatgattctgatgtttactgaaggttgagaactgcaaccctgtgggattaataatgactagagaatctgagaggtgagtcacaatgatgtatgtagtggtatggtgcttcccatgcaaaacatccatcattggcactaacacgggggaactctggagtctaaattccaactcagtcttggcagggggtccgttgtgctgaggaggtcctcggagaagggacagcctgtaccagggcatagagatgtggaagagtctggtgtgcttgtgagctgcacactgcatcaagtgacttgaacatagtcatggagtaggttctgtggagggcactgggcacctgtgactttggccaggtatgtctgtgcacatggtgggtagtaggaagaagctggtgtgctgatgagccaggctttgcatactgggcagtcttcagttttgccaggtatcacctaaaaaacaaggctaccagggcagggaggggctgagaccaggagggtgcactgattgtggatccccgaggctttagctctatcttgaagggaatggggtgccgtggaaggacacaagcaatcctgtgcagagtggcatttattgctgtctccattcagataaaatgtgacaaggggcattctacccatgttccctgaacaattccgtcactaaagtctgcatacagcactccaacttttttatcatcagaacagcctcatcctgaggccggagggaattagtagaacaagttctggcattagatgacctgagtttgtaactgggccctgttactaattagctgtgtgactatgggcaagttgctttccatctcagggtcttagattcctcatctatgaaacggattgataatatctacctctaggaataaactagctaatagacgaaagtgctgagcacagtacccagcatgcaacaagtgcttctaacaaggtagcaatcattggatgccaatgtctcaccatgagccttaggtaatagcccctccagataccagccttgggttggaagcagctgagagcctttctacccggccctgctcctctctggattctaccctgggcatgatccctgagtattgtttgtctgtttgccttgtaggcgtcatccctcaagtgtatcacttagttcaagagtcctggaatcttttcacatccactatgaacacctctcacctcctggccttgctgctcccaaaatctccacaaggtgaaaacagaagcaaacccctgggcaccccatacaacttctctgaacattgccaggattccgtggacgtgatggtcttcatcgtcacttcctacagcattgagactgtcgtgggggtcctgggtaacctctgcctgatgtgtgtgactgtgaggcagaaggagaaagccaacgtgaccaacctgcttatcgccaacctggccttctctgacttcctcatgtgcctcctctgccagccgctgaccgccgtctacaccatcatggactactggatctttggagagaccctctgcaagatgtcggccttcatccagtgcatgtcggtgacggtctccatcctctcgctcgtcctcgtggccctggagaggcatcagctcatcatcaacccaacaggctggaagcccagcatctcacaggcctacctggggattgtgctcatctgggtcattgcctgtgtcctctccctgcccttcctggccaacagcatcctggagaatgtcttccacaagaaccactccaaggctctggagttcctggcggataaggtggtctgtaccgagtcctggccactggctcaccaccgcaccatctacaccaccttcctgctcctcttccagtactgcctcccactgggcttcatcctggtctgttatgcacgcatctaccggcgcctgcagaggcaggggcgcgtgtttcacaagggcacctacagcttgcgagctgggcacatgaagcaggtcaatgtggtgctggtggtgatggtggtggcctttgctgtgctctggctgcctctgcatgtgttcaacagcctggaagactggcaccatgaggccatccccatctgccacgggaacctcatcttcttagtgtgccacttgcttgccatggcctccacctgcgtcaacccattcatctatggctttctcaacaccaacttcaagaaggagatcaaggccctggtgctgacttgccagcagagcgcccccctggaggagtcggagcatctgcccctgtccacagtacatacggaagtctccaaagggtccctgaggctaagtggcaggtccaatcccatttaaccaggtctaggtcttctccctgccatgtcccttgccaggctcttccacttagctaagtgggcacactgcaagctggggtggcaccccagcattcctggctttctggggtccagataggctggcaagagctgtttttgcatccatttgcatcgtgaagactggcattttgatacttcagctgtttgttcctgggagaattctgagcacagattccagaggtcacagtaagccttgcagcttgagctgaaagatgccagagccggagatgtctgctggcagcaggcagggttcattctggtgacacagcaacagatgcctggcctgggaacccagggatttcacctccaccagtgagaccacggggccactgtggggtgagggaaggagcgcttggagtcagagctctagaccttggtcaactcttcacctctgtgagagatggtgtgtggaggtgcttcagaagtaaagaattctaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcaagactccgtctcaaaaaaaaaaaaaaaaaaaaaaaaaaaaaaaaaaaaaaagaattctgtggatgcaaagcagtgggattactgttagatcattagcgcatccagctgaagacaatagatgcagtagtcttggcttacagccctctgcagcaggaattccaggactcacttcctactccatcccttttctctatcactgtgtcttccaccttacatggaaatcagcctgcaagttcctctcctcgatgagatggcaagcgccttgcaggtgaaatccataccatcatggggcttgtgtcttacatgccatggacaggccctggcacaaggagagagctccagggaagttttccatggtgggttgatggtaaaggtgccactcactgctgaatgtttggtgctggacaggagtccagcatgggaagggggccagggctcaggctcctgcagccatagtctcctgcctgcccttccttgcctcccaggacctcatttgatacagtagctggactgagactctgtggctctccccactgttgacccactacagaggcctccagaactcaaggctatggctgcagcctccttcactctgtgctctgaccactgagctgacttgccccagataatgtgccacgtatctttcaaagcttcctcagggtattgggcatcccagtggccttaagtaggatcaggggcagggagtcctgggagtctaacttcatggggcactggctgaaaaaagcaggtgtccccttcctccagccatccagggaaaaaggagaaagggctccaatgagtgtgaatatcttaccttgggggttatggcctagtcctctggatgctgaaccaggcccaaggcttcatctatgtgtggaccagacagcctgtccttacagggaaagaaatgtcaagactgctcctgggctgcattggatgggatgtctccgcatggttctgttggctcagactgaccctccagcagagtggacagtggctggcctactatagcctcccagggcagggtattcatgtgctagagccctggaagagcctcatcataagccagcataggttctgcaaagggggtctggcatagggctctcacccctgaccaagaaccggtggaactgacgcccaagacaagtgctctttgagccagcagctcccttcctggagctgtttgtcttatcgcttcttttggtcacatctcccattcagttcctttgttcatttttgtgttggattttgggcagatttcttgagccattctcttggacacagcttgtgcttgtcctgtggtgccatctgctgctggctgctccaggtgaccacctgccagcgaagcccaggctccgggacccatctattttgtgaaaagcccacatgcacaaagcaacccccaaatgccaaaggagccaagagaccaaagaaggaagcagacaaatccagtttgttggtattgagtgatttattgagggaacttttaagcaggcgggtggtctcgggtggccacaagacaggcagatctctgcactgttactctcggacccaaggcttatataccaagggaaaaggatatacatgctccagcaagacagtgaaaggtagtgtgccagagcaggcaagaacgccatgtgcatcatagcccagaatttgcatgataacatcaagcttgctttgatctaaaagcaggagtacatattcttacactcgggacagtaaataaagtaggagtcaggaggcattcatgggactggggctaatcagaagtcaacatgggaaaattagcatccaagatggagtcacttttgtcttcccatcaccccagaaagatgtcattgttcaagcttcccaaagaattgggggcctcaggccccccctggatcccacgcaagtgcctggagttgcttctcattattagtctcgatggtgccaagatgctggggacaaagatgatttcaggtgcagacatgcttgaggatggagggccaggctaggcctctggggaaagtgtttggtgctaagaattggggtagtgggtagaagcctcgttgagtgtgttctgtgccccagcatcacctggagcttgtagatattcagagtccttgttgccagcccagctcgattgaatccaaatccatgttttatcaggatcccaggttaattgtgtgcacattaaagtttgagaagctctgctctaagaaacaggttgccctggagcctagagacactgggtaagcacctgtagacacccatcctagttctgggaacgtctctaaaattgttattgctgaaaaggtgcattcagttttggttgtctgtctcatctctggctgcatgtggtcatattttttgtgaggctttttcattcttttgataaatatttgccatgtgcatagtttgcatagatatgttcttagtgaacatggctttttgtattctgctctatttcacttaaaactgtatcatcaacagtttttcatcttgctggatatcttttttttttttttttttttttgagaaggagtttcactcatgctgcccaggctggagtgcaatggcacgatcttggctcactacagcttctgcctcccggattcaagcaattctcctgcctcagtctcctgtgtaactgggattacaggtgcctgccaccacacccagctattttttttttttttttttgtatttttagtagagatggggtttcactatattggccaggctggtctcgaactcctgacctcaggtgatccgctctgctctgacttccaaagtgctgggattacaggcatgagccaccgtgcccggcctagatatcatttttgatggccgcttacaagtgtacaaactgccccagtgaaagccagtacccctcagtatctctagctcctgggggtggtggggggggtgggagggcatctctagccagcaagtggaccctctgccacccattgtgggaggaacccaccttacagaggaggatcatggctggaattggagactcataccacaaagactgactgggaacccttggaagatgcaaaactttatcacgtcctggctgtgagtgctaaaaccttgcctaatgctagcctttcttttttaaagtattgatgtggcctttttttttccattataaaagtaatcatattcattctgaaagatatacaatatatacaaaaataaaattgaaaaaaggaaattatcaggagttccaccactcagacataatcactgtttacattttggggagtcattttaaaagttttcatatgcatagtcatatacatatgtctgttttttaaaaaaatggttgagagcatagtgtgtccacatgggaacttataaatcatatttaaggattgttttatatcttttttgtttaacctgatataaatttttattcacttgtttattcattaaacaaatatgtcagacactatgttagctgcggggatacagtggttgtaatcagacattgtccctgttctatgcaacttagagtccattgatagatatatcctatgtccttaatatcatctgttgtggcattctgagctgtctctagacctgttgcatagagttttatgatgaacgtctatgcaaagaaccttttctatatttggaattatttccttaggagagatttccagaagtggaattaacaaagggcatggacagttttcaaggctcttgacgtgtgctgcaaagttgatttccaaaaaaggtctggaacaatttcagggcactccctgaagagtgcccatttcaccgtaccctggccactgttggtgatttaccattaaccaaaagactttgacctgtatcgcccagactggagggtgtcccagctcctgcctccaggtccagcaaacactgtgggcactgaccattcaaggctagcctgaccctgtccctctgtgaaacctttgggggttccacaaagcctttagggttgcaggaccacataacttatccaaacagggatacttgagcatgaaaggggccaccatgaataatcaccctgggacaacaggcaaaactaccctgggaaatgggaacatgagatcatcctactatagataaatctgatccctttaacatagcttaaattcaaccctctccaccatctggccccaacttaccttttcagtctctttgcatcctgacatatcacacgatccagtcacagtcggcctgcaattaccaaccatgccttgggtgtcactgtctctgtacatctgctcccgccattccctcctcctgcctccagccaccccaccccccgccagtctgcaatgcgccccctcgcccatctgtgtaggtccaaatcccacccttgcttcaaaacacaaattaaatggtaccattcaatactgctttcattcaacaaacatgtactgactgcttacgatgtgtcaggcacatagagtacaagaccgaaaacatcccacctcctgtggaactttgatttgtgtgtgcaactgtgacaactggtcctaaagatgaacacaaaatgatgtgccagagagtctgccctgttatggttttgaatagacacacccaccaccccacaaggttatgagctctttgagggtaaaatccaagaggctcatcctccacccttgcaaaacctctgacacacccttggatagagcaggcacttaagcatttgccaagtgaagaattaatattaaagaagcttacctattcactccgcaagagttttctaataaccagttctgggttctccatgaatctgagatcaaaggggagcctaaatttccacataccttagagaaacacccccaggtcctaccactgtgactctctgtccaccctgatactggaagaaactgaagtcaccggattcactgattgctgcttcttgtgaggttaagtgactcatccaaggtcacacagctagatagtgactgagccactggaggggtcaggaggtgatacaggaaagaatcagaatgcatgagtggataagtcaccaaaggagtcactggagtggaggggcctggaggggaaggtgaccctgagtgctggaatggccagagaagaacaaacaagctaacagccccaaagacctccattgtccccagatcccattcactgtcatctcctgaagaacatcactctcacaccatcagtgttctctgctcctttttgcacaaaactcctccagagacttgtctagcctctttctctctctttttttttttttttttttgttcttttagagacagggtcttgctctgtcacccaggctggaatgcagtggcacgaacatagctcactgcaactcgaactcctgggctcaagtgatcatctcacctcagcctcttgaatagctagcaccacaggtgcataccaccatgtccagctaattaaaaaattaaatcttttttttttctttttttgatagagactgggtctccctatgttgtccaggctggttttccttttttcttccttttttgtagagatgaggtctctctctgttgcccaggctggtcttgaactcctggcctcaagtgatccttctgtctcggcctcccaaagtgctaggattggcatgggatactgtgcctggccccctgtctaatcctgaagcttccacttcctctcctcttaggtgctcaccagtccattcatatagctcttgccatgttgccaaatcctgtggccagttctcagtcttgtctgatatggtcgtcagctgtattgggtagttggtcactcccttctccttgagactcctgcatgtggctttttcagggcataatggtcatggttctccctgcctcattgggctcttcttccccatctcttttcttggactcttgttgccctgattttgggacactggagcatccccaaggagccctggaggtcctctcattcccctggtgagctcacccagttttctggtgctaaatgccacaaatactctaatgttccccagtgtatctccagtctgaacttctccctgacctccagatttgggtgtccaggcatgctttgtgtttcctagacaccagtcagcatctcaagcttggcacattcaaaagcaaactccagatttgtccctgctacctccttcctcagtgtcctccttttcagaaaagggcaagtcctgcttttcatttgcttgggccacagtctttgggatcacctcctattcacacccctcatccaatctatcggtgagttctgtaagctgtgccttcaaaatgttctcagaatgaccacttctcactgcctccaggctctgccttcaggttcaagccaccgtcctccctacggagatcatggcagaggcctcctttctggcctcattcagccagagtgatccactgacactagtcaggtgcctctacaactttgttcaaccctccagtggctttccatcatactcagggcaaatttcacagtcacagtctgcacctgtgtctgcagatcatccgcccctctctggcctcacttcccactacccttcccctcacccactcctcttcagcagtgcttgcttctctgctatcttttgaacaggctaagacctctcccgcctcaggcctttctacttcctactcttgctgcttggaatgccaccccttgatatcaactttctcccttgctcccttcaccttaagtgaacctttattagaagattaatttcctggctgggcatggtggtttgtgcctgtaatcccagcactttgggaggccaaagcaggcagatcacttgagcccaggaatttgagaccagtctagacaacacagtgaaaccccatctctctctacaaaaattacaaaaatcagctgggcatggtggcacaagcctgtattctgagctacttgggaggctgaggtgggaggattgactaagcacagaaggtcaaggctgcagtgagccatgatcacaccgttgcacaccagcctgggcaacagagtgaaagcctgtctcaaaaaacagaagactaattttttaaccatcctgtaaaaatataaccatcctccctctctcttcccttttctgcccagtttctgccacaggacttagcacattggctggttctttgttgagggtctccactccctcattagaacatgaaccccatggaagtaggcactgtagatgttttatttactgtccagctctcagcaagaacaggctgttcacgagaggtgcagaagaaatatccatagtacaagtgaatttccaactgttatagttcatcagtggagagctgcacttcagcctcttatttgtggagagcgggcatctggttttgtagctgtttggtcccaagtttgacagccgttgtctgctgactgaaagggagctgaagcagctccctttgcatcctggtttcctggtttgtaataataaacactggctgccatgtatttagtgccccaaccactgtgccagatgctttatatacattgccttccctcaatcctgagatcagatagatgaagaaactgaagcttatagaggtgaaataattttttccacattttcaataagagccaaagatgaaacccaatcagttgtcttccaaagcctatgacttagactgttgtagcaggaaggacagttggccagatgacctccaagtggccttgaagctcatagctagaaagtatgagctttatgggcaatggagaagcactgaaagcttttaagcagggggatggcatggtcaggttacatggagggagagtagtgtggctggattggcctgcattccccagaaagcagaagctggggcagaggtctatgagcttttcctttattagggagaaagatcccagggaacaagatgaagaatatggggaaggagacagggaaggagggagagtcaatctgaagatgcgctactgagctggcagctgattactcggtatctcttaaaaccatcttaggacagtttgtctggacgaaaaaagaggtaagaactcatccatcggtttccatattcccttggcaaaggttcgtacatggagcattacctccccacactctggggacacacaggaacactgaacatacctggacataaacagagcaggtcctgcagagatgagaaggatgtttggggtgtgaggtgaggcgccatcaggtcgcacctgtgtgaagccagtgagctctctcagagctggtgcctcagtgggtgctggaccaagaggccagtgaggacaagaggatcataagcagagcagaaacagcatccaattcagggtcagaggaggtggtgtgggctgaactgtgtccccccaaactcatatattgaattcctaaccaacggtacctcatcatgtggccttctttggaagcagtgtcattgcaggtataattagttaagatgaggtcatactggaatatagtgggtccctaatccaatcccttggcaaaggttcatacattgagcattgtccgtataagactggtgtccttataagaaggggaaatttggacacagaaacacacacagggaggatgtgttgtgaccatgaaggcagagttcagggtagtccttctacaagccaaggcatgctgaagatggaagtaatccactagaagctgagggacaggcacccaacaggctcctgcacagccttccgaaggaaccaaccctgctgacaccttgaccttgaacttgcagcctccagaactgtgagaccataagtttctgtcgttttagccgctctgcctgtaacgctttgttgtggcaaccccaggaaactaacagaggaggtgagattgggggcagggaggcccatctgtggggggcatcatgtcagtcaggcactcagtaactgggggaaaatcccaaactcaagtgggtgatggcaaaatggggaaattatcggctcatggaatggggctctccaaaggaagttctttgacttcaggcttgattcaagggtttgaacgaggatggtagggctctctagtccttgcccccttgtctccacatgttttgaactgcacgtttgtgtgcctccagaattcctatgttgaaaccctaacccacaatgggatggtatgtggagatggagcctttgagaagtgattagatttagttgaagttatggggattcttcatgacgggattaggcccttaccagaagagaccaaagagcatgctctctctctctctctctctctttctctgtctttctgtctctctctctctctctctctctgccatgtgaagatacatcagggagatgtccatctgcaacccaggaagagagccctcacgaggaaacaagcaggccagtaccccagtctgtaggacttcccagcctccagaacagtgagaaataaatttctgtggtttataagccacccagcttaaggcattttgtcacagcagccagaacagaccaagagaggtgcctgtgtcttgatctctagagagagcattggccaaggccaacccagccatgagagagagacagagagaggcagggctgggctgtggctggctggggtgtggactgatccagagctggcagtgggccagaggaagttcagctccccagggctggatctggtgagaggacatggaggtcagcaaacaagttagggtcctgaggcaccgggtgggggtggggttcagcaaggaggtcttggtggacaggatgtggcagtggcagaggagctagttctccagagctgagaccagagatgataccaggtaagtggcccttcacctgtgctctgtggcctcacttctgtagagaatcgaggccagcttcagggtcaagcttctcggctggaagctgggagttgttgctgtggttcactgagtggcagggatacagtgatgactgagaaaatgctgaagagacctggaagtcccccatagaagaaatctgattcttacagcgctgcggagaggcagtctgggaaggcctttcttcccagagtatctcttcaaggttctgatacacctcacaagccctgcaaatacagacagaccggaatggggctcccaggtccagaggagatattgggaaagggtccgaggagcagagcaagatgtctgcttagccggcagtagccagcactcccggcctgggcagccaaacaggcatctgcaaggggacttgacaatgatcggtggagcaggagggtgcttgagagtgtggctgcttaatcatggccttgaggtttgttgttgtttaaatgtcaccacttatttgaaactaattcctgtcagactgcgaaaagtttatcagtgtaattgggtgccggcaaaaagctctcttaaaatacacatcctttcattcataaagctatcaatggggcatttgattagcatctttttgactgccaaggaaaccatactgaaagcagggcatgcattcagaacaaagaactccagctcgtgggtgaaaactctgcgatagccatatctcccccaccagatagtgtgctttgtgatggctggcagcctgtgccccttggaaatgtcattttcagccccttctgggcttgtgactaaggtgtgggtggtggatctacaaaggatttcccaaaaagaaggcctcctttacataccttttgttctgtggactgacccacttgtcccacccacatacctgcagcaggcgggagagttgtgccttaactgggcagctgtgagcaccagtttttttccccaaattcctgggtgctatctgagcatgctgctatttggcagtggggcctcagtcacatcctgatggagaaaatgtgaaggtttgtcatcagcttatttaacaattcagaggctggagtctattccactttttgtccagtatgtagctttaaaacagttacatataacatggaacagtatgacatgaaaagagagaggtttatagagggagatgggaatcgtgacagcccctgcttacggagtttgcccctccagtcctgaattcttctgcatccccacatcctgcttgtctggaaaacggctgcagcttactacttcgattcttggccttccagaaactggactcctggcccatcttttcatctctttggagaaacaaacaacaaacaataatctcgtcataattaaaattcactgtgatataaagctactctaaaaatagtacaattaaaattaaaatttatttcatttcttgagctgacatttcagacagccaggggcctcccactaaacttgaaggtgatgagtctctgctcagtctcacctcccgggcttctgttccagcatgagtctgagctccattcaactcttcccgggccttttcagctctaggtgtaaaggttcagtgtgaactcgtagaaagaagacaggcttttcagtcaacagatctgaattcttacacgcactgtctcatagtccttggtctcagtttccatgtttgtacagtgaggatcatgggttccaaggatttgggttccaaggtggggttggacaatgaaaccatagctgtccagtgtggtggccatgggccacatgtgacttctgagcacgtgaaatagaactggcacaaattgagatgtgccaagtgtaaattacacattgaatttcaaagacagcccctacaaagaatgtgaagtgtctcattaataattttgtatattgattatatgttgaaatagcaatattttagatatattgggttaaagtatgaaaatcaacatcaatcttttcgttttactctcactattttttagagcagctttatagtcacagtgaaatggagtagaaagaacccaaatgaccactccatctgtcctaagccagtctgagggctttctgtccagccctaacgctgtaccatgatcctcactgtacaaatatggaaactgagaccaaggactatgagacagtccttataagaattcagatctgttgactgaaaagcctgtcttctttctacgagttcacactgaacctttacacctagagctgaaaaggcccaggaagagttgaatggagctcagactcacactggaacagaagtccaggaggtgagactgagcagagactcattaccttcgagtttagtgggaggccactgggctgtctgaaatgtcagctcaagaaatgaaataaattttaattttaattgtactatttttagagtagctttatatcacagtgaattttaattatgacgagattattgtttgttgtttgtttctccaaagagatgaaaagatgggccaggagtccagtttctggaaggccaagaaggacttcccgtatccttcctgggccccaaacatgcacagcctccccgttagctacactgtccactagagtggtgtgtttgttacagttgatgccagactccatggttcggggtttgctcttggtgttgtacattctatggatttggacaaatgcatcatgacacgtaaccaccattatagtatcacacagaatagtttcatggccctaaaaatcctccgtgtcttacctatttatcacctcctttcctgttaaaccctggcaaccaccgatctttttaccatccccgtagttttgccttttccggaaagccatgtagttggaataatactgtaagttgtctttcatattggcttttttcacttaataataagcatttaaagttcctccatttcttttcatggcttgacagctcatttctttttagagctgagtgatattccattgtctggatgtgccaaaatttatttatccactcacctactcgaggacatcttggttgcttccaagttttggcaatgatgaataaagctactgctgtaaacatccatgtgcaggtttttatgtgaacataagctttcaactcctttgggtaaatatcaaggagtacttttgctggattgtatggcaatggtgtgtttagttttgtaagccactgccaaacttcagccgattcctggtttccctattctcggcaggctggcctcacaaagttcgtctcctgcagagctccaaggaagctggttttggctgaatctgaagatgatcaacactggtaggatgctgctgtgtcatagactggaaccccagctcctgatcatgctggagtggggctgctgctccctgcaaccccacctgcctcccccttgagctggaagagaagggctgacggccagagttctgccataccccactacgatcagatcaagctctgatcccaccaggccaggggctgtgcttccttgatcatataagcccaaggtccggggtcgctctcctggagtctgacatcagcccggctaggtcccagtgcgctgctctggaagggtcagaacgcttgttcctgagcttatctctgtggattttccctgatgaactctgatctagcaggcagtgtatgggctgctaagtacttttcccttgtttgctcaaggagtttgcggccccaagatcatttccaaagccttttgcttcagcttgctaaagggaagctgctgtcactctcttcagcttgctaaagggaggcggagttctgaggaaggcaggcaccttaagggatgttgaaagttgcctctgtttgctgtgcctaccacctacttctagtcctcctctcgccgcccagatcatcccctacaatgcattacccatgcctgccccccaccacccagaagctatgggggctctggtccaagccccacacttgtccgaaagaggtgcctgggccccacagaagccttgtcagatgatggcagctctcttctgatagttcaatggatctgccacctacacagagaggtctggaagtcgctaactctctttgagtctcagattccatagtagtcaaatgaagggtttgaaccagaatattttcaagaatttgtgctcttctaagagtccatggtttttttaaaagttaatttaagttttaaaatttattttttattttatttaaacatttttatttattttttaaaatcttttattttaggtttcagggtacatgtgcaggtttgttacataggtaaacttgtgtcatggggatttgttgcacagattatttaatcactcaggtactgagcctagtacccaacagttatttttctgatcctctccctcatcctactctccatactcaagtaggccccagtgtctgtcattcccctctttctgcccatgggctctcatcatttagctcccacttataagtgagaacatgtggtattttgttttctgttcctgtgctaatttgctaaggataatggcctccagctctagcctacactatggaatactatgcagccataaaaaagaacgagatcatgttcctgtaaaggacatgatctcattcttttttatggctgcatagtattccatagtgtatatgtaccacatcttctttatccaatctaccattgatgggcatttaggttgattccatgtctttgctattgtgaatagtgatgcaatgaacatgtgcatgcatgtgtctttatggtagaacgatttatattcctttgcgtatatacccagtagtgggatttctgggttgaatggtagttccgtttttaggtctttgggggaattacctcactgttttccacaatgattgaattaatttacactcccatcaacagtgtataagcattcctttttctctacaaccttaccagcatctgttattttttgagtctatgatttatctttgtgggaaatagagtaattttaaggccctccaacctctccatggaatgaagtagagatctgccagcaaagccagcatcaggaccgagtagaatatccagtacatggcaggtgctgcgtgatttttgttaaaatcataatctcattttaagaggactgtcctacacaggccaagcttgattccatggctcttccagttaatttcctcatctaagttagtattagccatgtccacatctgagctgtgctattaaaagccagaccagcagcctcattgctcccatcgacaggcatatggtactagataaaaagccataaatgtccaaactgttgagaaaaaatgtgagatgagttgagggggacacaggttgccagcctgccactctgggccccgtgctggcctgggtgcagccctgtgtcctgtgttgctgacctgtctcccagtgtcaggcttgggcctccctaggaaaattttccatggggctctgggcctcctcctccctcctgccttgcctgaactggccccacactcaggactggggagtgtcaaagtgtctgagcctgggggaaggaacaaatgcaaagcacgtgaggattcctcctctggggagagtttatcccataagtaatgacatcacggttccccagccttccaggatggcatcctcaaggtcatcttcatcctctcttcctctacaggctctgccactgcagctacaaactgcagcgaaggcccccattaggaaaaatactccccacgactttgccagcccctgttctggaccttcttcccctcagagccaagccccacaagagtgttctacactcctggccaccacactctcactttctctttgcttctcagctgacaggcattttcacttctgtgactgctgaagctgctctgcataaaagcccatctctactaaagataaaaaattagctgaatgtgatggtggacaactgtaatcccagctacttgagaggctgaggcaggagaatcacttgaacccaggaggcggaggttgcagtgagccgagatcgcaccattgcactccagcctgggcactaagagcaaaactctgtctcaaaaaaaaaaaaaaaaaagcacaagtggcatggtcttgccatgcgatttgggtccttgcaatacttgatctttgcagcttcattcttgacatcacctccctgaaatctcctcttcccttagctcccatggcctgactccagctaggtcctctgtccctcatatgccaggctttcctggttctgctgtagcttttgtgtcctgcccccaacaccctccataagcaattgcaactgtgccccgttcccagactcacaccttctccagtctccgtctacctgcaggctggacgcctccacggcgtgttccacacatacctcaagtgcaagtccaaagcaaaatatggtccttctcagattccagctggattttccatcacagttattcctattgtgaaccactgaattgcctagttaggggcatctgattcagacttgttcctttagcttggactatgtcaagaacctccctcaatgacatctctgccaccaggccttttgtccagcgatcctttctctggacaacgtctcacatctgaccttgactctcccactcagcggttcctgccctctgcaggatggggtccccgtgctttcacatggcccctggccattcacagcttccccctggctggccttcctctcctgcttgttccagcaccccctcactcccaccccatgcttgaatccacagactccttatttttgggtcctcacatatgccacactgtgcccagctcaatgccttccgaatctcatgctttccaattccaagtttaccttctctgaaaacttttcctggctcccttgtttcgtgtctgcatccctggattttgcactttgccttgttcctgttgggcacttagggaatcttagagctggaaggatgcaatagagtctccatcttttcacctggctgtaaccccggcaaacaaagggtgtaggttgttatctcctgggcagctggcacagtgcctggcccagaataatgccccctgagagcacagtaaattggtttccaccgtgaagaacagatattggagcttgaaggtgagctagcctccaacaggggaccagggaggtgctaggccagcgagcccaccttccccacgatgcagccaatcaagactccagagggctccagcaacagcatgaaaaaaatagctctccatacaaagcatggaaactagactttagggcctaggggaatggggcttgtctgcctctatgtaagaaagcaggacaggccgggcatggtggctcacacctgtaatcccagcactttgggaggccgaggagggtggatcatgaggtcaggagttcaagacctgcctggccaacatggtgaaacaccgtctctactacaaatacaaaaaattagccaggcgtggtggtgggcgtctgtaatcccagctactcgggaagctgaggcagagaaatgcttgaatttggagggaggaggttgcagtgagccgagatcatgccactgcactccagcttaggcgacagagcgagattccatctcaaaaaaaaaaaaaaagaaaagaaagcaggacagtatattgcaaattaagctcaataaaaagagagaaagagagggagagagagagaaagagggagggaggaagggagggatagtgagaaggaaaggggcagtcaggcagaccatggtcccctgccaattctctgggcaccggtggaagcaagttctgcgtcttgggcacagtactttatcacctgattgtacttcctccacctctccccaggcagaactattgacccagggatctataacatttgtatatatcaacacagaaaccaattaacaaatgcttatattcctgtgcaaatatgcaaacttccttctgcagacaggggtaagcagacacctggcagtatttttagaaatatttaagaaacacagttcaggtaagaagcaggctgctgtaccctcctccgggaggaccagtacctagaaccatctgtttttctttgtcttccctgctctgctctgagcgtggggatggtccttatccttagcttcatctttattaaagctggcattttcggctgggcatggtggctcacgtctgtaatcccagcactttgggaggccaaggtagatggatcacttgaggtcaggagtttgagatcagcctggccaacatggtgaaaccccgtctctgctaaaaatacaaaaattagccaggcgtggtggcatgtgcctcgagtcccagcactcgggaggctgaggcaccaggattgcttgaaccctctgcagtcagccaagattgcgtcacggcactccagcctgggggacagagactctgtctcaaaaaaaggaaaaaaaaacagctggaattttcttcagtgcttacgctgtgccagatacatgcatttactcacttcacaatgagagggaagccactatgtttatcagtgaagcagggtcatttgggaagcattatccaacaccacctactatgggcccagcccatggcaactggaagcagcactactcagaaggaaaggcatgtggagaagctcagagctgacaggggagtctatacttgattgtaagatttctgtacaaaatgcctttctgtgtgctgtatcatgtagtgaaagataagaaacaatagaatgtccagcaatcagagaaggcttgacatgacaggctactttttaacagcactgagaaaagcttgctatctattaaatattttaaaatcaggtgctaagccgcagagtaagcacctcattatttggaaatgcacttatacattcacagaagcaacacccctggaaggaaataccccagtgatcatgggattgtagtaacatttttgtttgtactttttatataccttaaatttaaaattccttatgaataggtgaaaagcctgtccaggaagctttgtagggtcccctgagttcttggtgttctgtcagtggaggctggtttgagtcattcctgtaggagagctacccaaaacaaaacgaaggggaagcaagagatgcaagcttctaagcctctgacaccttttgcaaaattgctttcctgcaaggctgtgctgcttcacctgctcccccaccagctggtgtgagaggcacagggtttggagcagacagctgtgttctgaagggatggcattctgtctggtgacacttagtggcagtccacttttctcccacaggttgctggctgatctagttgccaaggctcctgcgtaggtgttatctccaaacatgcaggcatagttaagagatgagaaatacacgtgtttggacaaaagactggagcacagttcaatcagcctcagcaacattatctctaaaagcaaatgagtcctgctgttgctggggacctacccctctgccttggctggaagtgtttgagtctgtctgaacggtctgttatctccagggcaacataaagtttgcaggaggcctgttcactccaggtgttatcgctgtcgctgagatggtgctaagcctacaggcggcagaaggccaattgctaaggcagagggagcctttagtggggagccaggcagcctggggaccctgggccacagcttccttccctatgacatgcactctcatgcccttcccactcaaacatccagtcattctgcacgtcctggtagagggagatgccaggcgaaccctcggggtaaccccagcacctggaaaaactcctcagtgggtttgctcagtgtcatttaaggatcccaaccttgaaggttttggacttgggatcacacattgtttcattcagagtgttaggataggggtctgtctagttcaggcatctcaagttagagatgagaaaccagactcagaagtctgacggtccttggaggctggccgagagaaagacctgaggctccccgtctccctgcctgggcacctcataccaccttgcttttccctgccccatgtcaagagcaagctggagccgaatttggggctcccagttgggctccaagtgtgatttcctccacacttgatgaccaggaggccatttgtaggaggctgggatgagcaaagtgggtcaaagtgccccctgcctccaaatgctcgcgtggaggttgggcagtcagacaccatgggggagaaaccccaggactttagcagaacaaaagaagggcaccctcccttcctgggccctgccagactcttggcagaaggccagggctactcatggggcggggagtgggggaaggagggaggagcagggatggtctgttccagccctcctgtgttcatcctgagccgagtcactgaggcctgcagcacagctatgacacaacttttggggtgtcctggtaggagggctttgggctgcaggtggggcattggaagcagatttctctctatagtaaggcagtagatccccaggccttgccctctgttcctgaaaatgtgagttgtaccttgaaccacaaaatggctgtggggtgcagcttggtgtgttggaaggagggctttggatgtgggctgcaactgcatcatccttgctcagttctcatgtggcaggtgtgctcctgcctggtctggggcagtctggcaggctgctctgtagccccaagcctggatctgccaaaactggcaaggagtggaggcctccccgtggagcagtgcctgaacctgcagcccctggggcagacactcctggctcctgggcacctcactcaccatggctccccactttcttagttggctcgggccgctattgcagaatgccatacaccacgtggcacgtggacaacataagtttatttcttacagttctggaggctgggaagtccaggatcaagtagctgaaacagatttggtttctggtgagggcctcttactctttcatagatggcgccttcttgctgtgtcctcctatggcagaaggggtgagggatctctccagggtcttttataagggacctaatcacccctgcacaacccagcctcctaatagcatcaccttgaggtttaggatttcagcacatgcactttgggtaaacaccgtcaatctagagcatcctccccccccatcatgctggcttccagactctgctcccaagtgaatgtccacacccaaggggggccctgagtcttccttaagtctctttgtctaggacagactgtgctgaaagggcccatctaatctcctgatatggtttggctgtgtctccatccaaatgtcatcttgaatgatagctcccataattcccacgtgtcgtgggaggggcctggtgggaagtaattgtatcatgggggcaggtctttcccatactgttctcgtgatgctgaataagtctcatgagatctgatgattttataaagagaagttcccctgcacatgctctcttttgcctgccaccatgtaggatgtgactttgctcctcattcaccttccaccatgattgagaggcctctccagccatgtggaactgtgagacgattaaacctttttcttttacccagtcttggatatgtctttattagcagtgtgagaatgagctaatacatctcccaacagcctgggccccacccacccccactcctcaaacctcctcagtctgtccttgtacaggttccttctcctccagccccatctcgcttcatgtgacttctttcttccttaaactctctgcactctctcctgctcccaggattttgtatctgcagtttcctctgcctggaatgtactccacctggtctacaactcccagctagcctggagtggagagcttctatgtcactccctctgggatgctcctgctgacccccaagactggctcaggccctgagttcgaccctcttgtggttcagagaattcctgggcatagccatgccctcacttgtgcttccactgccacatggggttgctggactgttgtccacttcctcaggggcatctgcttcctcagaacagggcctgggcattttgtcacctaggattccagtgccagcacagagagtgggctcagctgcagacactcagcaatgttgactgaatcaggaggcagcaggtgactcgatgttatgggctcacgggaaaacccctctcctcttcagagggccttaccctgaggtggcctcaccccagttgtcttcactgggtatgggtctctttgcccacccgctgctgcctcactaaccttcctggcctcagacaaatctaaactcaagtcaaaaccagggtgaagatgggcctacgtcagctccagagagggacagcctgaattcccctccctctggtcccatttccttgggaggatcagcctcttcctggatgatgacaccagggctcttcaccccctagggaggggtccagcccatgtctgtggctctggtctgggccctgaggggacacacagtaagtggcaaacacagacggaccaggccgagagcaagacaacatcctcaatggttaagatgtataggccagagggaaattgatcaggaaatgaacttagaagtatccagggactgatggggaaggagctgtatttggaggacctgtgatgcaagttacagaatcaaagatgtggcccctggttttgctgtgtcctcctggaatgggtagcaggacaggagccaccatgcagagggtggtcacacactcgggcttgctttaacctgggtctttccttaccaatgcatttctggctacactggggaaaacgaggtggctaacacattttttttaggtgttagaagacctgtgtgcactttctctctttctccctgcactccagccacactggcctttgagtttgtagaatgcctacactctgctctgcctcagggcctttgcatgtactgtgctcactttatggaaagctttgttctcaatctcatccaatctctttaattatttgaatgctatccatccttcaacattcagttcaaatatcatagccagtaaaatctgctgtaataaactctcttagtttcctccaatttttcttcctaatatttatctcagtttgtagtcatgtattcttgcgatggttgggctaatatctgcctcctcactggtgtttaacctctagtaaacactagaggtttaatctctgaggtcacatctctgagggcagagatatgagtgacaggtccagtcttattcccaacatcaaggccagagcctgtcaggcagcaaatgcttagtaagcatttgttgagttgactttgaattgtcagagctagagggtcggtttagcattgacacatgggggacatcatgggagaagccacgttttgttaggacctggccctggggagatttcttaagccaaaggctttgggtctgccacccttccatccaaggagaagtctgaagacagggtcagcattttgtttgtcctccacagttgctaactttttttttattttttgagacagagtctccctttttcacctaggctggagtgcagtggcatgacttcagctcactgcaacctccgcctcccgggttcaggcaattctcctgcctcagccttccgagtagctgagattacaggcatgtgccaccaagcccagctaatttttgtatttttagtagagacagggtttcaccatattggccaggttggtcttgaactcctgaccttgtgatccaccctcctcggcttcccaaagtgctgggataacgggcgtgagccaccgagcctggcccacagttgctaacttttaacacacaggacatttcatgtaaaaattgtgacttgcagcttcttttgaagaatctgaagtcaagcagccctggcctgcatttgtgcatggctacctttgtgggatcttggtcacagctgaccctttgggtgggcatgctactcttcagttagttgggccctcttcactagttttttcactagtttttagcacctgcttgcccctgttagcaggtatggacttttacctgaacactcagattagaaagagatggaaaaaccacatggccttgcagaataagggagatctcatctccatgcaatgaggaatcagtggcaggcctctttgcagaacctccctggaagggaattgctatggttgcatgtgtcccacaaagtttatgtgttggaaacttaatccccaatgcagcagttttgagaggagggagtaatgtacagaaaaatatccagaaatctgtacagttgatatggcttggctctatgtccctacccaaatctcctgttgaattgtggtctttagtgttggaggagaggcctggggggagatgattggatcataggggcagatttcccccttgctgttcttgtgatagtgagtgagttctcatgagattatcactccccctcctgctccaccatgtgaaggatgtgtttgctttctcttccccttcttccatgattttaagttttctgaggcttccccaaccatgcttcctgtacagcctgtggaactgtgagtcaactaaacctctttaactcataaattacccagtctcaggtcattctttatagcagtgtgagaacagattaatacaacagggttccccatggatctgttataaaaattaggttgtggatgtctatcataaaactccaggaggctgggcaaagggtgattggaaagcagtgagcaggcactttcagagctcatgtgggacatggggggactcctgcattcctaccagccagagtggagcgtccttgtagaaaatctggtgcgttcagttgacatcccagaaaagtcatgtcttggcaggaggagtaaagaagccctaaataaagtctaatctaacccctttccttcagtcaaagcttcaaaacaaacctcaaaagggtcagggtaatttctaagtaactcagctggctgccagaaaaatatctaccaatctttagaggaggacaacaaaatctagcattaagtaaggtataattaacaatgttcggtgtcatataagaaatacagacatgtaaaaatgcacagaagtgcaactcctaccaagagaaaaaccagtcaatagaaacacactcaggaatgatggatgttggaaatagcacacaaaggattgaaaacaccaattacagatatacacacgaatttaaaggaaacatgaaagtaatcatcaaagaaggagaaaaattaaaaaggaaatacaagggccaaaaataaaaatcttaaataaaaaaatttctttatgaaatgaacagattagacgtgaagaagaaaagatcagtgaacttgaaagttgcaatagaaactttcaaaactaaaattcagtcaaaagagactaaaaagaaaatttaaatgaatctttagtaacctgtgggaaaatattcatgcaagtatatggatcacatacttgtaattggaagctgagaaggaaaggaaagagggaagagaaaaaatatttgaataatggtaaaaaatgctccaaatttgatgaaacatacaaaaccacccatccatgatgctcaatagatcaaaagcaagataagcacaaagaaaactatgcaaggtaaaacataatccaattgctaaatgccagtggctaagaaatgtgggtgggcttcatcaaatctattgaagatctgaatagaacagacagactgactctcctgcaagtaagagagaatttcatcctgcctgactgctttgagctgggaggtggttttttttttttcctgccatttttgaactgaagtatcagctttttatgagtcttgagcctgccagcctttgaactggaagtacaccattggctctgctgtttccagcttactaactgcagattttgggacttgtcagcctcaataatcataggagccaattccttacacacacacacacacacacacacacacgttatgcatatgtacaaaattatatatagttatatattatatttaagtataatcatatctatctattccaaaattgggtctctaatctgattacattttaagttgctaataactttatttccaactgtaaagagagcactaatagtccatggcatgatctaacaataaagatatcaccactggatactcctaatcaaccccttataagagacaaggagctgggtaactgtgtatactttcaattattttcctcacactaacaaatataataagactcaccaggtgtttctaatgtgaagtgatactaagtggacaaaggatgaaaaacacttaatggtaagtatgtgggtaaatacaaaggcttttctcatttttaaatttccttaaaagataattgattgtttaaacaaaaataataacaacgtactgtgtggcttataacctattaaagcaaaatatgtaatgatagcatgatggacagaatggaggaaatggaagtatatggttgtaaggtcttacattgtacataaagtgttataatagtatatttgtaatgagctaatgatacatattgtataccctcatgcaaccactaaacatgaagccagagttatagctaatgaactcacagtggagataaaatagaaccataaacatttttaattcctctaaaagaaatcaagaaaagagaaataaaggatgaagaacagatgaaataaacagagaacaaatgacaaatggtagatttatacccaactatactgataattatataaaatgaaactggtctaaaaattccaataaaaagacaaatatttttagactgtataataaggcaagactcaactctatgttgtctgaagacctcaataatttaaaggcacaggtaggtcaaaagtaagaggatggaaaaaaatatactatgtagcaccaattataacaaagttggaggggctagttaaatatcagaaaaagtaaacttcagaacaagaaatatgcagaacaagaaataaacgagaacatttcataatgataaatttatcagaaagagaaaaattgtaaacatatattcacctaataatagaacttcaaaatatgacaaagaaatggacagaaatgaagggggaagtagagaaatctacacttatatttacaaattgtcatacttgtttctcagtaacttatagaacaagtagaaaaaatgaataaaggggaaggacacttgaacaatactactaaccaacttgatttaattgatgcctatagaaccttctacctaaatacagatttttaggtgtagtgttttatatcctaggaatgcaaagtcagtttaatcaacagcgcaataaatcaatcaatgcaattcagcatattcgtagaatccacattgtttccaactgaacacaaaactttcattataatggaccatatctggggcagaaaacaagtttatacatttaagaggaccaaaataatatagaacatgttatctaaattcagtggaactaaaatagaagttaatagcagaaggatatctagaaaatccccaagtatttggaaactgagcaacatacttttaaataatacatggatcaaagagaaaatcacaaaagatattttaaaataatttttcctaaataagaattagaacacagactatcaaaatttttgtaatgattagagacaaatttataactttaaatgatttttattagaaaatataaaaagtccaaggtcaatgatttaagctttacttttagaagttggaaaaagaggagccaattaaacctaatgtaagtagaagaaaggaaatcaagttaatagcagaaaacaatgtaatagaaaacggaataataaagaaagtcaataagataaaaagttctttgaaaagatcaataaaattgataaactcctaataaaaagtcataaaacaaactaccaacatcactaataaaagagggaataaaaattacagactatgtagagattaaagaaataatatggggatattatagaagctttacggcaacaaatttgacaacccagaggaaatgggaaaatttttcaaaagaaaaattactaaagcccagtgaagaaaaaatagataacctgaatagctttataaccattaaagaaattaactttgtaattaaaaactttcacacaaggaaaattccaggctccagtgacttctctagtgaattcaatcaaatatttaaggaagtagtagtatcacttttatacaaacttgcagaaagtaaaggaggaggaaagactttctaacttaatttatgggatcagcataatcctgatatcaaactcagagaaaagatactacaagaaaaaaatcttataggccaatgtccacaaggaatatacatgcagctgggcaccatgctcacgcctgtaatcccagcactttgagaggctgaggtgggtggatcacttgaggccaggagttcaagaccagcctgggcaacatggtgaaaccccatctctactaaaaatacaaaaaattagctgggtgtggtggtgtacgcatgtaatccccgctattcaggaagctgaggcaggagaatcacttgaacctgggaagtggaggttgcagtgagctgagatcgtaccactgtactccaggctgggagacagagcaagactctgtctccaaaaaaaaaaaaaaaaaaggaatatacatgcaaacatccttaaaatatttcagtatgttgaatctaggaatatatgtagagggtaatacactatgaccaagagtgcttatcctagaaatgcaaagttaatcagtgcaattgaccaatcaatgaatgcaattctagcagtttaaagcagaaaacccaggtgatgatctagatagatgttataaaagcatttgacaatatgcaatactcattcacgatgtactttttttaaaaaaaataaaatcctcttaaaacactggagtagaagggaaactcatcaacctgaaaaaatgctgtcatgaaaaacctacaggtattatcaaatttgatagtgaaagtcataacgttttcctcctcaggttgggagtgaggcaggaatgtccacttttgccatgatcattcaacactgtaccaaaagtcctaggtggtgcaataatgtaagaggaaataccgacataagattcgaaaggaggaggtaaaactgaatccattcatagaagaaataataatgtacttgaaaatcctaaggaatttacaaaaagttactaaaataagcgaatttagcaaggtcataagatacaatggtcaataaacaaaagatcagttgttttcctaaattgtggcaatttggaagattaaattatataaataatactgtctatagtaccatttgaaaatacttacaagatgagcaaaatctctatgtaaaaaactatgaaacattgtggagacaaagtgaattgccaatattgttaagaagtcagctctcctgatttttggttgaaattgacaaagcgattccaaaatctacatggaagtacaaataatctagaataatcaaagcaatttttacaaagaatgaatgttgaggacttatctactttatttcaacattacaggaaagccagtaatgaagacatgtggtataggtttcagtttagacaattcatcagtggaacagaatcagatgtcctgtttctggacatacataatatgttgattcctaacaaagttaccaaagtaatttgatggggaaaaagatagtctttgaataaatggtgctaaaacaagtgaagatctatacatgaaaaaagtgaacttcaacccttacctataccataacttgaaatgtatcacagacaaaaataaaagctaaatttgtaaagcttctagagaaaaacataagagaaaatcttcacaacttgggcaggcaaagatttctcagggcacataaaatttttgaggaaaaaaattgataaatgggccttattgaaattaaaagtttttggtctacaaaagacaccatgaagaaaatgaaagggcaagttgcagaccaggagaaaatatacacaggtatttggcaaagtaatggtatgcaaaaattaaaaagaaccctggaagattagtaagaagaagacaaaacaactttatcaaaatgggcagaaaattttgagcaaacacttcccgaaacaaccaataaacacataaaaagatgcactgcagcattacacatcagggaaatgtgacgacccctcacaccatgaggatgcctgaacttaaagatcgacaattctgaatttttgtaagaatcaggagcaactggaactcttgtacaatgttagtggaaattcaggattaatgctgtcacttcgaaaaacagtttggaagtttcttatgaatttaaatatatacttaccatacaaaccagaaatttccacatcaagttaaaaagctgcacagcaaaggaaatgacaaagtgaagagacagcctacagaatgggagaaaatatttgcaaactacccatctgatcaataaccagaatctatgcaaagctcaaacaactaaataggaagaaatctaataatataattaaaaatgggtaaaatatctgaatagacgcttctcaaaagaggtcatacaaatgaaacataggcatatgaaaaggtgctcaacatcattgactgtcagagatatgcaaatcaaaactacaatgggatctcatgtcaacccggttaaagtggcttttatccaagaaaggcaataacaaatgttggtgaggatgtggagaaaagtgaacccttatacactgttggtgggaatgtaaattaatacagccactaggatgaacaatatggaggttccccaaacaactgaaaatagaactaccctatgatccagcaatcctactggtaggtaaatacccaaaagaaaggaaattagtatatcaaagagatagctgcacttccatgtttattgcaacactattcacaatagccaagatttgaaatcactctaattgttcaccaatagacaaatggataaagaaactgtggtacatatatacgatggagtacgattcagccataaaaaagaataagatcctgtcatttacaacaacatggatggaattagaggacataatgttaaatgaaataaaaaaggcacagaaacacaaattttgcatgttcttactcatttgtgggagctaaaaattaaaaatattgaactcatggagatagagagtggaatgatggtcaccagagctgggaaaaggttgtgggtgtggggggtgggaaatggagatggttaatgggtacaaaagtagagttaaatacaatgaataagatgcagtatttgatagcacaacaggttggccagtcaacgataatttttagtatatttaaaaataagtaaacgtgtataattggaatttttgtatcacaaagaaatgataaatgcttgaggtgatggataccttgtttaccctgatgtgattattacgcattgcatgcctgtatcaaaacacctcatgtactccataaatatatacacctactatgtgcccataaaaataaaaaaaaaaacagaaattcctctcctaggtatttatttattcaagaggaataaaaacacctgtgttcacaaggacttataaacaaatatttataacaattttagtagcctcaaactggggaaaaaccccagacagtagaatggataagcaaattgtgatattgctgcagaatggaacactacccaacattaaagcaggagagattacagatacacatgacaaggagaatggagctcagaaacattatgatgagtgaaaggagcccacacaagagactacagtcatggtggtatagtttggctgtgtccccacccaaatctcatcttgaattcccgtgtgttgtgggagggacccagtggagggtaatggaatcatgggggcagatctttactgtgctgttctcatgatagtgaataaacctcatgagatgtgatggtattataagggggagttcccttgcacaagctctctctttgcctgctgctaaccatgtaagacgcgacttgctcctccttgcctcccgccgtgattgtgaggcctccccagccacctggaactgtaagtccattaaatctttttttttttttgtaaattgcccagtcttgggtatgtctctatcagcagcttgaaaatggattaatacacaacgatgctcaatgacagtgatgcgttctcagaaacacatcattaggggattttgtcattgtgtgaacatcatagagtgtacttacacaaacctaaatggtacagcccattacatacctgggctctatggcatagcctgttgctcctaggctaccaatctgtgcagcatgtgactgtactgaatactgcaggcaactgtaacacggtaatatttgtatatccaaacatagctaaacataggaagggtagagtgaaaatacagcatagaagacaaaaagtagtgcacctctgtggggcatctaccatgaatgaagcttgcaggtctggaaattgctctggatgagctagtgagtgagtggtgagtgaatgtgaagtcccaggacatcattgtacactattacagattttataaacactataaacttaggctacactaaatgtattttaaatttttttcttccttcaataataaatgaaccttagcttctttatgttatcaactttatttttttaactttttgacttttttatattaatacttagcttaagacacatgttgtataactgtacaaaaatattttctttctttatatccttatcctataagcttttttctttttttacattttaaattagaaaaaaattaaaatgaagacacacacattagcccacacctacccagggtcaggattatcaatatcactgcgttccacccccacatcttgtcctaccagatggtcttctggggccgtcatgcacatggagctgtcatctcctgtgatgagagtgccttgttctggaatccctcctgaagaacctgcctgaggatgtgttacattaactttttctttttaataagtagaaggagtgcattgtaaaataatcatgaaagtatagtatagtaaatacataaactgctaacagtcgtttgttatcattgtcaagtactatgcactgtacataattctatgtgctagattttatacaactggcagtgcaggtttgtttacaccagcatcaccacaaacacctaaataatacattgcactaggttgttgccaggcgataagattctttcagctccattataatttaatgggatcaccgtctgtagttgactgaagtgtcacacagcatgtgactgtatgcatattcacctcctagaacccagactcatacgaagaagtagggaataccctactcgcaaccatgttttatttcctagtttcttccattggccattttctttttcaggctggagacttccctcccatccccactggcgttcccagtctctctgcctcctaagtcttcctctgttgctctctggggaccagcttgtgcagcagttttgtatcactgtagggtagggcttcaatgagccctgtcctgtgtccttccctggctcactgcgtcttgccttcccttcctcgcacagcccagggcctgacaccacctcctgcagttggtcattcaggagcagggcactcagggaaggagacggctctgcttcgagtatagcctgggcaccatccacaaacgccttggtgtttgaactcacctgtgcatcccagatacaggtatagtctctccaaaacaaagggtgtaggaaatatttttacttctccatctttccaaagtatccttcccttagtatctcagcaaccttccccggagaggctctttgggctgtggatgtagtacccagtatcctgggctgcagattcattgattttccatgctttgattgggtataatcatgctcagagctgagcaaggttggcagtgagtgggtcactgacatcagcttattcatgatctctctgtgctccgattctgacatgaacttccttttctgtctcagaggagagagatttcagggctgtgagcctgaggatggaccaacacgcacgtcagttgtgtctctgaggactaaagatggccaggacccaggaccccagctagcctccagatgctgctggctgctggggacccgtgacctaaggcacacccctcaacacattttctttcattcctgtcaatctcctgtactggtgactgggctgggacctcctgctggcctccagggccccacctgagcctctggtcccggcctcagtcaggcccaggcctaggggaccggcttcttgtttcctttcccgagagctctctgggagtccttacaatagattccaacccaggcacttttgacagtgaaagaagatttgtattattttcttagggctgccgtaacaaattgccacaaacttcacggtttaaaagaacagaaatttattatctcacggttctggaagtcagaagtccgaaatcacagtgtcacagggctgtgctccctacttaggctccaggcaaggttcttctttgctttcctgcttccagtagctccaagcttggctcgtggctctgatctctgcctccagcctcccatagccttctcctctgtgtgtgtctctccttttctgtctcttacaaggactgagtactcaaacttatatctaacaaagtactggtatcaaaaatataaaaattactcctgcaattcaataataagaagacaaacaacttaattaaaaatggcaaagtcaggatgaacttacctgaagatccttaatttaattacatctacaaagctgttttatccaaataaggttatagtcacaggatccaggagtttggacccagaccaaccttttgtgggggccacaattcaacccactccaggattttaataataactattccataacaaaagacagaacaccatgactgtccctccattcacctgcatggcctctgaaacctaaggacaccttagaagtggcatctctagctcggcgtggtggttcatgcctgtaatcccaacactttgggaagccgaggccggcagagcacttgaaatcaggagtttgagacaagcctgggcaacatggcaaaaccccgtctccactaaaaatacaaaaattagccagatgaggtggtgcacgcctgtaatcccagctatgtgggaggctgaggcaggaaaatcatttaaacctgggaggtggaggttgcagtcagccgagatcgagccactgcactccagcctggaagatacagtgaggttctgtctcaaaaaaaaaaagtgtcatctccaccactggctccctgggccacagacaggcagggaggaaaaggactcagatccctcgtgtgccttccaccgacggcttcgcctcctcctctaacaggtctgtggtctgatgttgagtccatgtggcccccagtctatgccggaggtactccccggctaaccctagaagccagttgtattagtcctttttcatgctgctatgaagaaacacccaagactgggtaatttctaaagaaaagaggtttaatagactcacagttcttcacagggcagcaggagagagaatgagtgttagcaggagaaatgctgggcacttataaagccatcagatctcacgagactcactcactatcatgagaacagcatgggggaaaccgcccccattatccaattaccttcatctatctagtcctaactttaacacgtaaggattatggggatcgtaattcaagatgaggttttgggtggggacacagccaaatcatatcaacgatgttatcctgtcagaactcaagagaagggtgagggctgggggagggccgggggatgatcccatctgaagtggccagtggaagcagttggccttctggagagggaggcaggaaaggctaggaggtaggtggccttggaggcccagagggtagggggagaacgtgggggtggagtgacagctggacatcccgaggtagggactggaaaaggaggcctagggagttccagatgtacccacctttctctttgtaacttaatgctggttgcatgacctgtaggtaacgttgcaggggacttggggtacagtatgagctctgtggttccctgctttgagaaaaggaatcctctttacaaactttctatgtgattgtggtgggggtaataataaagagagccccccactgcccaccacaagggcagtcagaggacccacattggccagagtgtgtcacacattggacgtgcttattaggttgggatcagcacgtggacagcagggccaactagggtccattgttaggaaactgagtgctgggagagcagttgtctctccttcggcatgtgctctaaggagtctgagcttggacctgctgagcaccatagctgtctcctggggagactgtgtctgaagctggagcccaacagagccctgcagaggccagagacggggagggaaagttcaggaccttgcttggactcctggatccaacctcacttcaaagtcatggtcacggatttcccagttagagagctcaccttgagaggtggggtctctgtcccatcccctggaatctaggtgagctctatgacttctctgacccatagagtgaggcacatggtgctgtgcccgcttctaagctcagggctaagaggctgtcagcttccacttcctgcctttctgatccagatgccatgctgtgagaaggcccaagccacatggaggagctgtgcctaggcctgcagaccacagccctcactcggttcccagctgccagctatgtgaggaagccacttgggatgtccagccctgtcgggcctttggatgactcagacgccatctgactaacccagggagagaccccacacaacacctgcctggcttagccaagccaactccttcaactgtgaaagatggtgacaaattattgttttaagccactaggttttgaggttattatgcattatttgaaaataattaaaattatttcaaaaactgtttattgtgactgatatggatgcctaaggtccttgcataaatgtgtcctcacttgatttagatgccaaaataggaatctgcaccttgaatctcatcatgagctccatgaagctttgggtagcctcaagaattctagagtgcaggggcttaaattcaaataactctggcagaacactgatggcctccctcctctggctgtatcatgcacagcctgcttcagctaaggggacagaaggagggagccagcatttctctgagaaccaattataaacaccttgggggaactctcatgatcagtaagatgctttctgagcatcgctttatgcatatgctaagaagctggggcaagagtagctttttttttaatagtacattttatgtaaatttttactgaagtgaacagacatatacaaaaatacacaaattataattatatggttcgattaatctttgccaagggaaccatgtcaccagcactcagattcaataattgaacattgtaagcacccaagaaactgacttgcaccctgtgttgatcatgcccccccaacagtgatagtcacctcattctccagaggccttaggcattgcctcaggatcatggtggaagcttctctgggtggggctgcttggggaccagccatcctgcagtgggcccatgataagcacctgtggcgccacacccctggctagcaggcctgctgggaacacctgtaggaagaccttggcaggatcattggcccttgagtcagctgcttgctcaacttcatgatcagagataaaggtgaatgcaagtactgtggccatgccatgcttaggactcgagaatggtgcagcctctctgtaggccagggaaggaccactaatatggctcccagccaagggcctcagggattctgaatggcacagtctctgcagaacttgcactgtgtggcttcaggtcttccaggacagctaaaatgtgtgggccttgagggtgcctttgggtgctcatagcctcattagggagatgaagaggtgagcagatgtcacatatgccaagacagtggaagcattaagaaaggggaaaggatggggaggatatcaccccaaaggtatgggaaaggacctggtatgtctggaaagtgaagaaggccagtgtggctggaacaaaaggcacctggccagagagctgggagatgagggcagacaaggaggaaggggctttccaggcaaggctgaagcctggatttacccagaaggcaatgaagagccaccagacactttaggggggccatggtgttgtaaaatgaagcatttgggctttgtcccaggttcctggaagggagcttggcattttcagggtggcaggagtgtctttgctattcatcgtgggtccctggggccacaccggagtttatgctgaccaggtgcttcaaggtgggactccatagcttcaggatgcaggctggccaaccatggcaagaccagccatgtgaataaagggtcaggactttgagccacatgatatcagcctgacctctggggagagagtgggtattggaattgagtacaaaggtgtaagcaatgatttcatcaatcatgcctaggtaacaaaccccaataaaaactctggacattgtagctcagtgcagccaccctggttggtaatcgtataaccatgttctgggaggcttcacatttgggaatctccccaaacctctccctgtgcatcttttcatttagcttgtcctgatttgtaccaatcaataaaactggaattgtaagtgcagaggttggtgagtcattctaatgaattatttattcaacttgaagccctgagtgggagcctctatcttggtagccagtgattggaagtgtgggtgcactgggaatgcagctggcatcctgcagggccctaagtctgtggcatctgtgctaacatcaggtggttactgtcaagactttcttcactcagtcaggtctgtgcttcaggtgcactgctctgtggagtggggagggggcctggagtgcatttctgctcatggggctcatgatttgaactcaggcctaatatgttaatgagcagacacctggccaagccctgggggcctcaaaaaaccaagacaggggaagcatcaagaatgtgatgagagagtacgcggccatgggagtgtcacctttgccttctcttctccctgtggctggaaaggctggcctgtctggctgcccaaggatagacggggagaggtttaattgaatcacctactgtgttgggtaaagtaaactgtcgtcattgcaaatataatcaggactgtattttaacagtagaaaatgtgattataatgacatatttatcagctcctttcacctgggtggatctgaggacatttcagaaaacaagtgattggaattgcttggcctacctcacacacttacacacacacactctcacacactcacagagacacacacttataagcacacacagtcctgtgcatgcacacaagtgtatacacacccacgcacatttccacatgcatgtgtgtgcacactcacatacacaaacacacagagacacacccttacagggcatctggtgctctggcctgctctgacacgcagcccctcctgggagtgggcagtaagcattggggggacatgtaggtagtccctggggaagctggaaggctgaccacctggcgagcagcagggcacactcactggagcccctgcctggatgagctggctttgctcagctccagctgtggttccctctgtagactgtgggatcagaaagccctcatcacatgatgtaactctcacaaggctgcaatctacttccctgtccaggtcccagaggctccaggctctttgtggagtcacctgcttgggcagccacggttctgtggagctgcttgtcagagagtgcgcaggctctggagtcagtcagacctgggtttgactgctgactccatctcttacctgctgtgtggccatgagcaaatgcctgttctcactgggactcagtttcctcatctacaaagtgaaacgtgttcatacttcccttatggtcagtgaggatggaatgggataacattctgcaccccgcctggccccacaggcatatgaggtattcgataagtgaatgattgtgccagacaagaaagctgcctgccctcctcctcctcggccctgtgcagggactggggtggatgagaaagcccgtgtttcctgaacacctgtttgcaccaggcacctatttggctgctgcctggatgtccttctcaggttccagctcaggtctcttggaccagtcccctggtctggggtagggatgcctggaacggctctagcggcaaggtcatatctcgccaggctgccaggatgagctgagcattgtgtccacggtgggtgtctgaaggaaataatgtatacagtggtccatttccaagaccaagtgccttgaatcggcttaggtcagcaaactatagaagcaacaggacatactaggcccctgcttggatagctgctgcctgcttgtcggcctcccccttcttccctcttccccacccccttagttgccctcacccgaaccaaagaagtttagataaaagtttattagtctgcaagatagcttgatttgtctcttcttgtcagcctgcctagctacttaggtcataagtcaaacacttgaagagcccctgagctgactaggattgcaatgcattgtgagctgcaacaaaatgcagcaagacaaccctaaaaaaaaacacctaaagcccctacctaacaatcaataggcaacatccgggaaaattgtgaccccatagtactcagtctatgagcaactgggggagggacccgtactctagggataaactgcttgtcgaaactgctgggtgtgcttgtccatcagacacctgatcttgcaagttcatcattaaaagtttcactttcgctgttctctgggtatctgagtccattctttgggtttggacgggtaagtttgtttctcacatgtacaagccagaggtccatgagtgagaatcgggggccaaggagctttgtccatggggccgtaatgggatgagagggcagaggttatcaaactctgagggctggaggaagacatggtttctacctcttatctcatttcctactcatttagccttcggaggcaggcactgccgctatcccaccgaggaggagtctgacactgtgggtggtgaaggccacagttacccggtgagtagctgggctggactccacccttgctccctcctacaatcaacctcctgctcctcccaacaactttcctgaaaggaggcagtgaccactgtgcccttgcagcctccccggcaaccgacttctgaatcatcccactgcagagatctcattactgcagtgagtgtggctccagcctcccctcccttggctgctaatgagcgccctaatttgattgcctccaaatgagtgtgatgcaaaattaaaagatgccagaagacatgaccataaatccagtgagttggcttcaatttattatgtttgaattcaattagatttctcctccgatgttttccgaatatttatctagctgctggctacagaacgataactggaaggggctattactgtttaattccagcctcctccattcagcttgggctctggcaataccgttggatggaaaatctcagcctggatgtggggaggtcaagggagttcaaggtcagctgctgagccttctgccagccagccagcatatttcctgttggggaagggattcaaagcaatataccctattaaaatgttttaaaaatgatttttagtgcataaacactacaagggactccacagaagggagtgttggtgtcaaggcctttgttgtgtcacaggcagcaggggggatggggatctggggtctgggctcagcctggccacgaactttgtgtgacttgggaaaatcactaaccttttccagccttggcttctccatttgcaaaacgacggagttggactctgggaactgttttcagtggccctggattctgcactgctactctccttttagtttcagggtgtttgcccactctccttccccacccccacagccatgtgtcctgcttgaccctgggaacctgacttctttaagctgcctctcaggctttcttactgactgggcagaggttggaattagccagtgggagactctagctggaaggcaaaagtataggaagagagagagtggtcagtgtatccccccaccccgtccccactgcccctccccaaggctgtgtctctccaagacatcagctcctgctggaaaccccttctccacatctctagctcttactggctgtggcaacactattcctctctgtctagccccatgagtaacagcatcctagagttgtttgttttcgtgcttctcaacatccctgttcatcctcttcacctggccacacttctgtaaggactactgccattaaagtctcatcatttgaagcattcaatgccatttcttgccatgaccctgaacaatgcagatactaaatccatttttcgactgtggttttccatggagggctccccaggtctagaggggagctgagacaaaagcattcccggcttgggagcctgttgtgcagttggggaggtcccagagcaccaaggccaagctggggagacgttgtccctatgggcatggccaggcctccggcctcagggaggagagggagacggtgatcatggaggggaggccctgggagtgagaagctgggggaattgttccaccctgcccctccccccaacctccagagagcgaaagacgatgggatgtgggaggacggcaaaggggaagaggaagaggctccctgtcctgctgggtccttagccaagttggaagtgggagagtgagaagcccccatctagggtaaaggagtatgcccccaggggaggagagaaaggctgatgacacagagggctcatttgctctgaaatgggcctcccagtggaacagtgacgaagaggcagagtcagccgtggcggaagagcaggaaggagaggagtcccagagcaggatggagggagcatcagggagatgggtggatggccagggctggcctatggggcgatgaccaaaggttgcaggggtgggttcaggaatgagaccaatgaagtctcctgatttatggcttccagctttggtgtaagtcaatgacccgaatccctggagaagggtggggaatctgactctgaatatgtggcccaggagccctgcatgaaggagctggggcctgaagagtaactctgcattgagtactaggcttccaaatcagatcctggccagctgctgtctctgatggctcccagtcctcccctcagacccatggctgtaggccagactggcaggggcaagaggcaggagccaagtgggacatgtccagtgtcctggccaaacatacactggacgcagatgagccatatgcctgggaaacagagaaatggggtgaggccaggtcttcttgtgagaatgaatgtgccttactctctcctggagagagggtgatgacaagagttcattcattcattcataattgctttttgatttaagcaggcgagtttgttgtttaacaggctgggaacatctctcttttattgaaacatgtgacatagcaggttaaactcctaaagattcagcacagcagatgagaatcaaggagtttccttcttaaaaagcataacttgcatatgaatgaagatgattccaaattatgttttttccccatgaccctaaaattttatcccaaaaggagttatcatattagatattgatcagatcagcatttcatatcaaagctcaggacatccatctaaatatttaaaaatctttcactctcacagcacatcttgtgatcaatgtaaaacaaacagataggaacaaatcaaatatgagagaagggtttatggtgagagaaaacagtttctatcctctcccctccccagtcctggcctcactctccagaggcaacttcttgtaaacatttccatttttagtacttctggtgggtgcctccacaatgcttagtagcatgtataggcacccttatttttttattcatctggagaaaatttatctacctcctgtgatggaacataagaaatggcctcattatgcacctctgcttcctcccttcatccttccaaagttttatcattttggcataattatttttagttttctgttatttacttttaaaactttaaaccatataattgtactttgattctgcattccatccacctcagggagagtaacggtctggggcggtcaggttgggtctgttcccataccctccccttcttctgaaaggactctcccctccctcccgggggcctgtgcccatgaccagccagtcacagggccaggcatatgtcctgggccctggccactgtgggatacaggcatgctccccaatcttgaccactaggaatcctgcaggactttcactactaaaactgctctcttcaggtcacaacagtaactatcagttcaactacaccaaaggtttctgaagacaatggcttctccacccaagcaggttgtatataaattccaaatagaacttggcatcaccctgaaggaattctaacttcacactgttggggaaatttaccaagatagcttcagagtaaactaactttacacagcacattaaaacaaaagacatttattcagcgtcatgatcagactattacatttagcaatcaacagcatgggtgcaaaaaaaaaacctatattaaaacccttagctggaatgctttacacttcccacagaacagaaactaaaataacctgttatacagttagtcacaaatacagtcctcgagttttttgcccatacacatgagtatttgtctaaaacatgtcttctttgtagcagctaggccctgccaccactgtgcttggctgagttcacaaatctgtcgtaacctgtagattccctgtcatttctctggctctcctctcctgctaagctttgtttcctaattaaaatctgccactgccatagctactgctgctgctggaaccgccaatagccaccttggtttcatggttttgcaaagtataggcctccattgccacaggggccagagcttctgcctccaaaatttcctcccttcatgggtccaaaatttgaagactcattgttgtaattgccaaaatcattgtagcttccaccacctccaaaattgcttccatcattaccaaatccattacagccatccccactgccaccatatccaccaccaccacgactgccaccaaagccaccaagaccactgaagtttcctccaataccaaagttgtcattcccactgaaaccacctccacgaccaccaccaaagtttccagaaccacttcgacctctttggctggatgaagcactagccatctcttgctttgacagggctttcctaacttcacagttgtggtcattcacagtatggtatttctgaatgacaatcttatcgacggagtcatggtcatcaaaagttacaaaggcaaagccccttttctagccactgactcggtcagtcatgatttcagtcaccattaaaagggattacccaagcaaaatcatggaattattggttataaaagtaattgttggcacatcctatgtaacatatctaattgaataatggtaccagattaaattatagatgggaatgaagcttgtgtatcatccattatcatgtgtaatcaataaacaatttaattctcttgaaaaaaataaataaaactgctctcttttgttctgggattacctctaggaaggaaatgtaaagtcagctcttgtagggtgcctccaggcccctgacacgtggaaagatcgtgcaggagaaaaccaacccagaggtcagtggaggtggagaggaagttgtgagagagatcaagctgtggtggtgagaaaggcagctggtcctgctcactgaagcctccattgcttccggactgtcacagttacaccgacctgacaatttcagtattagcattagagaattgtttcagctttccaactaacacagggtgtattgtactccccacctcaggtaagatgagaattagcacgtaggctgcctgtgctagttttctgttgctgctgtaacaaatttccacaaatttatgatttgcttagagcaccacaaatcttagttctggaggccagaagtccagcatgggcctcacggggctaaaatcagtgtcacagggcagctgtgttcccatgaggcggctgtgttcccataaggctccgggtggagactgtttccttgccttttccagcttctagaagctgatggagttccttggccagccactttctccctccattgtcacagcaggtgtggcttcactctgacctcttctgcttctcccttccaccgaagggcccctgtggttacattgggtacacctgggggcttagcctgtctaatattgccacaccctcttgtgaatcttcttttttcttttctaagagatggggtctcgctttgttgcctaggctggagtagggtggtgtgacggtaacaaactgcaggcttcaattcctgtcctcaagcgatcctcctgcctcagcctcccaaagtgctgggattacaggtgggagccacagtgctaggcctctcatgaaccttgtcttccagaaatgtgttggactctcatccattagtaagccatctttctctcttttttaatgcttttcccttatagatttacttcattttaaatttataagcttaaatttcagtgatgatgtcttaggaagaacaggagaggaggaacaaaggaacaaacttctttaatgggaagctgaaaggacccttttaaaagtgtgcagtggagagatcctgggcttggtctctggtaaacctggtgaatggtgggttaacactccctccctcactcggtgttgctgggaggataagacagaacatgtggcgagcaggtgtccaatagctgcctcttgctatgtgcagccagtgccacatccaggctgagtgctgtggggagtgtggctcatcccactggggccacccctggcctcgctcactggagactccagaatcagggctgactgagcagcttgtggcactgaagaatgttctaggaaaggaggtgtgtcctccttggaaggggaagcttcatggtgggtgagctgagggtaaggggtgggtgagggccatttgaagagtcacctcccctacattcttttatcttttggagcctccatccacgccacttcaaacaatgaacacacacatccaagtcagtaagtgcactttgtgtatatctatataagtgatgcgcaattactgtataacagttcactagctgacctgacattattcacatatcgtaggcatgtgactaattgtaggtgtgtaatgaagtgttcacatcttattacatatttaattcctaaggcatttctacagttttatttgagaattttggaactgccagtgtgtttttcatgtttcaaaccttttcacaggccctgaaaaaacccaaaggccttatattctgggaccgtaatggacaaaacagccctgggaagtatgcttgggaggatggcgaaggctgggtttgctgagggaggtgccagctaaggtgctgggcacaccagaggcaagggatctggaccacaactgtcagtttgatgaacacactaatggtggagtgacccccaccaggagtggccagcaagcagggtccaacaggaaagacatctgggaggccagcaggtggaatcctggctctgccaccttcgtgctatgtgatatcagccaagttacttgccctctctgattctcaaatgctcggaggccctttgacctctagagtctatgggacctgagtgaccacagggctctggtttgttggtggctgcctctttatttaactccttttctcaaatacggtctatgggctttgcttaaagtgaggtgtcctgtgcacactcttctccatgactttgaggccgtgagaaggcccgccctgcagaaggactgaggaaactagtgctggagtctcctttcttgtatcagtgaaggaaggggagagaggagataaagtgctcaggttacagaatgtgaggatcgtgccccttttttccaactgaagacattcctaggcattttatctcccctgttgcaacttctaaatcacaaaaaccttatgcatccagtttggctgacatccacctgcaatgggagtgagtgagattgagccactcctcaggtgaatggaaaattaaggccaaccaaggcccaccccatgccccactgtggggtctaaaaggagcaggcactggcctgctttctttttccctaaagaaagctctttggggacccagcagaaacagcagaggtggggatgcgagcttccgcctgcatttgttccagggtgggccagtgaggatttgggaggaatggtgtggaaaggccctgcccaagaaggctggatgctggctggggaatgcccagggtgccagctccctaccctggggaaaggccaggctggcatatgccggagccagggtccaaggtcacagagaggccacacctgggcacccctcccagcaagggaaggtccaagctgggaattacttctctttggaaagtgaggggagtggtacagaaatagtgctattgttgctgttgtcctgtcacttctggcattggaaatggtgttgagcttctacgtgacgggcattggaggtcaaacctgaaacaggtgaggcccatccctttactaggctcacgttctaggtagggaggaggcaggtacctcctccacctaagaaacaacaagagatagagaatgcagtaactgtcctaaagagaaaaaccaggggatggagagagaataatggttgtcaggacgggtcagactttaggatggtaaatgaggagtggtctctgagaagggatgaggcagaggaagtgaggctcagggaagtgaagcacttgcccaaggcagcctgctggtcatggcagagctggcaagctcattccctcctcattatgtcaaccttctgggaccagagtctgggcagggcagaaactactgcaccaggggtgcgtggctccagcagagagagacaaagtgccccatgcaatccagaaactgagccctctgggctcaatcttcaaaggaatgactctcagagttgtgtcccctgccttttcttcaccatggaacttttcccagctccactctggtgggcttggggacaggacctgccctctgcaaagtgatgaccaaggataagtcggattttcaaggagaccttggagaacaccaccctcttattgtgcaaaagaggaaacaggtccagagagggtgagccattttttcagcatcacacagctgacctggagcagagtttcctaaaagctccctcggtgctctttcccctgctgtggctagacccctccacaggaacttaacaggaacccaaaggaacgagtcactcatggcagaatcactaatgtgatggagggcaggagtgagagacggcataatgtcaatgctggcacactcctggcacacgggaagctgtccatgagtggttgcttcccaccacttccatcgcccagtttgggacatgtctgagatccagtgctgagcccagggtctagcatgtcatgggagctcaggagttcctaattgactacatgaatgctaaggtgtgggatgtgctccttcctgctttctcattctcaaagaacactcttatacacctggttgtggggagggtatataggcaatcaacttttgcgtactcacttccattgtaggatcatgcatgcatgtggacgtgcgcacacacacaaacacaaatgcacacacacacacacacctgccttctcaaacttgtgggaccagaaaggatgctgcaaggcctaagata

SEQ ID NO: 648 - DNA, 1685200 bp, Homo sapiens
  misc_feature (259637)..(409636): n is a, c, g, or t
  misc_feature (1361842)..(1511841): n is a, c, g, or t
aaaaacacaactccaaggatgaaatggaagttaaaggtaaacaggcaatagcgctgaatacgtaatttcagtaactcagaattttctccaacctctgctctaaagaagcttagctacagaagagcagttacctttgaaacattttccccaacataaagatatccggaatgtgaagctgccattaaaactgtgacacagatctacatttactgatacatcaaaacatccctaaagttcgaaatacgagctacagaatcacatcaaccgcctaacttgtctgtagcctaaactctagtccggagttcatctgcaagcggaattgggaagtatttcagagccagcatctcctcgcgccatccaggtacctacacacttgaggccaccgagtcacctgcgcagccgttgctcctccaagaccaatccgggctccccagacccaccggcctgaatctggaggacagcagtccgcgtgacaacagcgactcggagatcagcacccgtcgggaaagccgcgtacccgttgaagctggcgtcacgcccaaaggaacaaacgccagagcgtgtgtcctgggcaaaggcggcccgccgctccggtccccgggcagcagcggccggcgtcaggccgcaaggcgaggggcggggacaggactctacccggcagcccagcgccgagcgcccgcgccactccggccttgcgccattccggccccacgacggccggcggcggcagcgcggctgggctcagcggctcgcagcccgggcgccccccctgccggccgctcgctagctcagcctcacccgcagtcttgtccgctggctcgctcgcccgcctacaggtcgacagggcccaacgacccggcgagcaacttcacggaaggcactggccgacaacgctccgctgccgccgcgccccgcccctttgtgacaccacctaccaatcgctggacggcgctttcgctgccctccaatcagcgcgggcgggggcaggcctggcccccggacgtgggcggttgccggggcgccagggccctggggccttcttggcattcgctggaggttgtgagttacgaggcccggatgttgatcttttattactagcaacactggacccctgactcgtgcccacgcgggcgtctggagggcagccgcatggcctgctgggaacggcggggttgaagccggagccgccctccgtgagacccaccggggatcctcttccaggcgcctgatttgctggagataggcgatacaggcagacgctgtccagtcggtggcctctccagagtgaggggcgctcctggtgcgtttgggccggcctgtcctaacaaatctgctttaggcttcaccgtcccctaatgtttctggcctcaattgcctcatctggaaaatgggggcattaccgtgcctgcttgaagacaaaggcgaaaacagataactttctgtagtcctcatacaatttactgagaactgtaggccaggcaatggagtaggcaccctgggctcaaatcccagcgttgggtaagcccagccacacctcctgctccagtttccaagctgctgagctgcggtgtaaacagtaactggcttcaagccaacacctgcctttcaacctaacatgggagcccactgcctcgttccgttccccctaccgattttccaactccgtgaacctccttcactaagtgggttactcagctgacaaagaatgtcatctcactcccactgcgggttcactcatcctcgacttctggctcagaggagccagtctaatatgaaactaaacatctaatctgtgtctcctgtcctctctcattcttctgagaccctacccaccaacttatctccacagttcaacgaactattgagcatacactgggggagtatggtgaggcactgggcattgattcaccagtctcgccgttggttccttctgaaactccacatatgcttaatgctaaatagattggagacctttgaggacagagctatgatggtaatcatctttgcattcctgagcctagaatagggcctgtgatggagacttactgagtaaaaaccttagcgtttctcacccttgcctgcccacttcattcacactggagaattgacagcatggaccgtggagtcaggcaggtgtgtttaaagccttgcctcccaataccagaagctccattacctggccaagtcattcattctttacaacatcatcatcattatcatctgccattcttcaagtgccagatagttgataagggtctttacgtattctctccccatcacaatcctgcaaagttggtagtgaaatccctcgtctacaaaggagtaaacaaaagccaattaaagtagaacaatttacctataatcaaacagctctatgtcggaaagccatatttaaactaggacacaatacaaaaatccaaccttgttccattattccacattgcttccagattttagctttatctgtaaaattagtgttactacattacctatctgatagaccatggagactgaataaaatagcattaaaagttgttaccataggaacttttttttaacgtaagttctctctccctttcaagcctctcaaaatagcagcttgcgtattttctaaacctgttgtctcctgaatcccctgaaaccaatcctactgattgatgagtagatttagttgttccaaaagaaaatcatcgtatttaacaaatgctgactctgaccgacattgggtactacagcaagaaactatgtgcacaaataacctacggacagaaggaagatgcataaaatgaataggggaaaggagtggccaactagcaagtgccctcatctgtcatcacgtcactctcacagcagacttgggcaaatggttgacctgtgggagctgaacaaaatctttgactctgggtatgagtaattccctgtctgatcttacagtgcccaaggaagaagtcagtagctccaggatcgctgagaccaacctgggcggcctacaagactgcaccatggtgacaggctgaatagtcagcagcaagacgacagagcaccaaaaaacacagactagaatggggtcagccatccaggtggctagtggctactgcctttgacgatgcagataaagaaaattttcattcctgcagagttctatggggcagtgctgctctagaggctgacatttctatcctcagcacttcccccggctattacctaggttcattctgctgcttccacaaggcaagaatggaacagaatgccttagagcaatggtcagcgaactgtttatgtaaaggggcagggccaggcgcagtggctcacgcctgttatccccgcactttgggaggccgaggcaggtggatcacgaggtcaggagttcaagaccaacctggccaacatggtgaaaccccaactctactaaaaatacaaaaattagctgggtgtgatggcaggcgcctgtaatcccagctactcgggaggctgaggcaggagcatcgcttcaacccaggaaatagaggttgcagtgagccaagatcacatgactgcactccagcctgggtgacagagcaagactccgtctcaaaaaaataaataaaaggggcagatagaaaacatctgaggctctgtgagccatccggtctcgtcataattactcaactcttacattggaggtagggtgaaagcaacaatagaaagtaagtaaatcaatgaatgtggttgtgttccaataaaactttattaacaagatcagacagtgggggggggggggtagcatagtttgccaaacgaaaatccaataaaaatttattaaagatttaaatgtggccaagcgtggtggctcatgactgtaatcccagcactttgggaagcggaggcgggtggatcacaaggtcaggaggtcgagaacatcctggccaacatggcaaaaccctgtctctactaaaagcacaaaaattagctgggcgtggtagcgcgtgcctatagtcccagctactcaggaggctaaggcaggagaatcacttgaacccgggaggcgaaggctgcagtgagtcgagatcgcaccactgcactccagcctgggcaacagagcgagactctgtctccaaaaaaaaaaaaatcaaaaaacaacatttaagtgtaagacctgaaatgagaaaacttttcttttaggtttttgtctagaagtttctaggtattgatcttgacaataatttacagaatatgtcacaaaagtggagacatgaaaagccaaactaaacatgggacaatgccaaattgaaaaccttcacagcaaagaaaccaatgaacaaattaaaaagctttttaacaattatccaaaatacctaaagaacttgtattaataaataggaaaaaaaactgaaacaaaacagaaaagcatcaaaaagcttaaaaataagcagatttggccgggcacggtggctcatgcctgtaatcccagcactttaggaggccgaggtggacggataacctgaggtcgggagttcgagaccagcctgaccaacatggagaaaccctatctctactaaaaatacaaaattagccgggcatggtggcacatacctgtaatcccagctactagggaggctgaggcagaagaatctcttgagcccgggaggcggaggttgtggtgagccaagatcatgccaccagtctgggcaacaagagctaaactccgtctcaaaaaaaaaaaaaaaaaaacatgttcagcaaggttgaagcatcaaaggttaatagccagaatcatttatcaattgtatttctacacatctgcaagacacaatctgaaaatgaaattagaaaaacaacttcattgggcaacaagagcaaaacttcatctcaaaaaaaaagaaaaaaaaaatagtaatctacaatgtcatttcctgttcaagcttgacttctacctttactttctgatatggttttgccatgtccccccacccacatctcatcatgaattataatccccataatcctgatgtgtcgagggaggggcctagggggaggtgattggatcacgggggcagttatcctcatgctgttcttgtgatattcagtaagtcctcatgagatcttatagggttttgttttgttttgttttttggatggagtcttgctctgtcacccagactgcagtaccatggcgcgatcttggctcactgcagcctctgcctcctgggttccagtgattctcctgcctcagcctcctgagtagctgggattacgggcatgcgccaccacacccagctaatttttgtatttttagtagagacgggatttcactaagttagctaggctggtctcgaactcctgacctcagttgatccacctgctttggcctcccaaagtaccagggttacaagtgtgagccaccaagcccagctgagatctgatggttttacacatgtttgacagttgctccttcacatgttcccactctctgtgcggccaccatgtaagtcggacctggttccccttctgccatgattgtaagtttcctgaagcctacccagccatgcgaaactgtgaatcaattaaacctgtttcctttataaattatccaacctcaggtatttctttatatcagtgtgaaacagactaatgtgctttccgataatcatgcttcaggaattggggaattcagactacctgggatcaaattgtggccccaaccttagcagccatgtgaccttggggaggttacttaccttctccatctcaactccttcagtaaaatctgtaaaatgacattgtttctgagggttaaatgagcatagcacagtgtcaggcacacactacttgccagatgtcgagtattcatctttattgaaataggactgtggtaagccactttatggctctcgattttgtatgagaaaatcatgcttagtgccttgttagtaaaagaaagaaaacctgaaagtccctgccacggaaggaagaaatagcggggagaaaagggagttggtaagtttcagcatttcagagcttggagagggacaagttaggtttccattttatggagaaggaggtggaggcaggatgggtcctaaggtgtcattcaaaacacacagccataactctttattgagagtagcgctagggccccagggattgctgtggtcaagttgcggacaaaaatgaccactcgttggaagacaggagaggagtgtttagttacaaaagcagtcaacaattcaggtgtatctatattcagacagcaaataaaagttgttcaacttggttgctaatgggacccactctactgaggctttgtatagaactcatagaggaagatggcttcaaggaatgaactaccctgtgcttttcttaggactaaaatctcaggaagctggtgatgaatgaaaaccttagtcccactggcactgcacgaggggccaggagagcagcagcatcataagccgcagggtggggcagccaaggcaggggcattctgagctgttggggaggggtggcaggcagggtggggcactgtgagctgtcggggagggcattgtgaagtgtggggtggggcattgtgtgccacatgcctgggctcccacctggggccagtgggcttcagtctgtaggtgactacagaaggaggaggagctccgtctgttctctcttcaggcagttgttgtgtctctcagcacttgttgggttcacaacctattaaataagccggctggtcttcaccctcccagacaagtcaactcaggggaggcagcagggtgcgggccttggccagggccagggccagggccagggccagggctggtgcccggggccgcgctgtgaggtgggcaggcgaggagcgggaagaccatctctgcaagtgcagcatagcctcggcctaggacagcgggagtgcgtggccaaagctgtgagcagaggcacaggtggtggcagacagtagaggcaccccatggggaacatactgacctgtcgtgtgcaccctagcgtcagcctcgagtttgaccagcaacaggggtcggtgtgtccctctgaatctgagatctatgaggcagtagctggggacaggatggcaggagcgcccatggctgctgctgtgcagcctgctgaggtgactgttgaagttggtgaggacctccacatgcaccacgttcgtgaccgggagatgcctgaaggtaaggaggtgataggtgccatctaccctcggtttgcctctggctgctgctgtccccaaggttccctttgaggcatcccccactttgagctcctttctgcttgtagccagcttttccgggggctggccaggaacaaaagctggctctgccttgaattcccaccccttagtctttccccaccaagtccagtcagtttcttttcgcctcccctcccaatcgcccagttcttgctctctcacctcattctcccaggctggcatgggaccatttatttatggctcttgtcgaataagcagcagttgaataaatgagttgataaatttttataaatgattacatcttttttcttttctccctctatacatatagctttggagtttaacctttctgccaatccagaggcaagcacaatattccagaggaactctcaaacagatggtgagacaacagtgtctgtagctctgtttattatcctgtgggactttgtttaggcttctttgagctattctcttccttttctcaataaaaactcaaatatcccaacttttcagtacccatcttattttttctttgtacctatccagatggtacctaagtgaaggaaccaggtaagtgcctaattgtttcctttgttaaagtagtcaaatctcaggacagttcctattcaaatatttggggatttcttatttaaaatcagaatggagtttgccacgggagaggctatatggtattcttaatgggctgctttaagtcaccttgatagaagctgcttagtttcttctaactgtaatttgaacacagaaggaaaaagaaaaaaggagagtgcttaaaataattgtgaaaggtgtgaaatgtcacagccggggctgcagaaaaatggttgtgtgtgtgtgtttggggtttctcaaaggagtttacctatgaggctctgattactttaaaattcttactttaacagaaaatgtgtctccagatttattctggtgacttaacagactttatttacctccttgttctaaaagagaggtggggattggttcatggtcaaaactttcaaaagacatgaaacgtcaatgtagactttcaatgtgtaatataaagattgcaggttaaaatgtcagaccttccctgtaagagtgtttgttgccatggctccccctttgtcccttcccctcctgacaatagcatcttgttcaaagataagaaagttacagttttggctgggcttggtggctcacgcctgtaatcccagcactttgggaggccgtggcaggcggatcacctgaggtcaggagttccagaccagcctggccaacatggtgaaacgctgtctctactaaaaaaaaaatacaaaaattagctgggcgtagtggcacatgactgtagttccagctactcacaaggctgaggcaggagaattgcttggacctgggaggtggaggttgcagtgagcagagatcacgccaatgcactccagcctgggtgacagagcgagactccgtctcacaaaaaaaaaaaaggaaagaaagttggagttttttagtctctacactgctggcagaggcaggggatgggagccggtagaaaagagaaaacaattagttggtttgcctctaaaattttgcaaagagatgaatctaagtaaaagtaattctgggtaataatatggttcttgaataaaaactgaaattttcaaaatagaaaacattgcatcataaacatattacatccagtaggcttattggtttcatttaaatgccagagatttcatcactgtagaggaaatgtcttatagctcttctatttaaactttggttgcgctcttaatttttaaagaggtaggataattaagactcattatgagtgtgactttgtaacttggaagtactatcttcacatttcaagatatttaaggattgctttagaataaacaaatgtattatgtgaattaattgattgtacctttatacacaaagcatgtaagtacttgtgtaaacttatactctgcttggtgatgttcggaaagcctgatggatgttacacaccagttagtagatgggtagtgttggatgagagcccaaaaatggctctttattgtcattctttaggattacaacacagtttatgtatgtctcacttggccctttccaatacaaataaggcctgtgtatgttctccctatgtgttgctaatgaagaaatgaaaacttagagatatcacatgactatggaagacagctactcaagagaactaaggttctgtgtcctcagaatgaaatggaagtgacagatatgatgaatttactttttaaaaattttaaaaactctagaatacctcttatattttgcctataaaatagacctgtcttttaaaacttactgccatcttgatttattttatgcaaagttgattttacacaactcaaagccaaaatttacctcttcttttttttttttttttaaataaaggagggtgtcattatgttactcatgctggcctcaacttcctgacctgggttcaagtgattttcccatctcagcctcctgagtagctgggactacaagcatgtgccatcttgcctggctctgtcttgtgtctatacgctcatttcaatggataagaatcaaagtagagatagtgaaatagcctaaatgcagcagccgaataaacgagttgataaatttttatcaatgattacatctttttttcttttcttcctctatgcatatagctttggagtttaacccttctgccaatccagaggcaagcacaatattccagaggaactctcaaacagatggtgagacgacattgttttttccgccaagagaaagaataaaagctcttgtttgatcaggttatagaaagtatttagaaaaactcatattggtttaaaattttcatcttttcacatgttcccttgtcttattttaatatgtgatatactttcctttagttgttatgatgttagtgaaaacgtgtaacctttttgtttatacattttgccatctttttatcaacacaattaatttgtgatgtgatggaggagtcatggatttctctttataattcttggatttatctttatttataattaatggatttatctttatttataatcccttttcccttgctccaaaaagtacattttaaagatgaatgatagaacttaggcttcagcttggttttcatttaaacaaattaaaaaacgtagttgtttatcatcagggattgaatctgtgatttgggcctcctcttacacagtcctctgaccacattcatttaccacatccaagttcatgctactcaaaagttttaggttattaactttttcatttgatataatgtaaatttaaacatgccttactcctgcttatttcccttaatgttatgttaaatcctcatttatttgccaacaagccatacacagccaagttttccagttgacttaaacagcaagaacacaagtgagggttctataataatgtgcgaagtaatgcagcacagtaaaacacgggagtttgtaacctttgtttttatagtttgagtagactttgcccatcttgagtcagttatttctggttagaatttgtcttcattttttacattactataaagagatacctaaggctgggtgatttataacaaaaagaggtttaattggctcaaagattttcaggctgtacaaacatggctttaacatctgcttctggtgagggcctcagcaaacttacaatcatgataaaaggcaaaggggaagcaggtggttccacaccgtgaaagagggaggagagaggggaagggggaaggtaccacactctttttttttttttttttgaaatggagtctcactctgttgcccaggctggagtgcaatggcacgatcttggctcactacaacctccatctcccaggttcaagcaattctcctgcctcagcctcccgagtagttgggactatagttgggcaccataacacctagctaatttctgtatttttggtagagacagggtttcaccatgttggccaggctggtctgaaactcctgacctcaagtgatctacccgcttcagcctcccaaagtgctgggattacaggcttcagccaccgcacctggccagtaccacagtcttttaaattaccataatgagaatgtgcttattaccatggggatgggaccaagccattcataaggaatccactgccattacccaaacgcctcccactaggccctgtctccaacattaagggtcacatgttaacatgagacttggaggggcaacatatccaaaacatatcagaattgtatttcccagttccttccagaggcatgggcttctcacacctagagagcatggaagcagtaaaagaaaagctattccatgtccctcactcttcagtggtagtaacttttgcctacaaggccctcccagcatcaaaggcagaggcagtgtaggaaacaaagcatggcccaagtccctcttggggcttttattattctggcctctttttagggaaaaaaaaatgattttttgtgctgcagacaccatgtccaattaggtttgtatacttattttaacatcaaaatttaggccaggctctgtggcttacacctgtaatcccaactctttgggaggttgaggtgggtggatcacgaggttaggagatcaagaccatcctggttaacacagtgtaactctgtctctactaaaaatacaaaaaacaattagctaggcatggtggcacgtgcctgtggtcccagctagtccggaggctaaggctgaagaattgcttgaacctgggaggcagaggttgcagtgcgctgagatcccgccactgcactcgagcctaggtgacagagtgagactccatctcaaaaaagaaaacaaatttaagataggttactttccagttgtgtaaagaccattttttaattttgttttgtttttagtgacatattagtagataaccactaagtgtggttcaagatgcttacagggtttctgttgcatctagagataggtgtctggtcaggaagtagtttttagaactgttagctcttagagtctgataattaaagtaagctatgtgtaaatgcagaatgagagaatactaatggatcatggctcatatatgcaacagttaaactttttattagctaaatttttcatctggcctaatttttttgcccttttcttttgtacatgaggattctttcatttgtatgtaatagaaacaaaaagtaaactaaatgaaaatctaagtttttagatttgacttatgaaattaatcatgccagataatttaaattatatgttattgaaaattttttttaatggaattttgtctcatttttcataggagtaatcagtaagatgttaacaactacttttattttatggtatttgtatcagaagtgaccagtttttttttttttattcttagttgtagaaataagaagaagcaactgtacaaaccatgtaagtaaacactcaaatagttaagaaattgatagtttgacataaatggatgtctctcttgatttctttaaattacaatgtggacctggtggtggtagcatggacctctttttgtggattttctaaatctcttctattttcctgagtattaaatttatccaggaaagtgcttagtttagcgtgtccaccttttaaagatttctgacatttaagttaaatttcaatagtccggttcaaaagatctgccttaaggctgggcatggtggctaatgtctgtaatcacaacactttaggaggccgaggcaggctgatcatctgaggtcaggagtttgagacaaccctgaccaacatggtgaaattctgtatctactaaaaatacaaaagtagctgggcgtggtggtgcatgcctgtaatctcagctactcaggaggctgaggcaggagaatcacttgaacccaggaggcggaggttgcagtgagccaagatcgcgccattgcactccagcctggacgacagagcgaaactctgtctcaaaaaaaaaaaaaaaattgccttaaatatttaatcttatttttaatgaaagaacaaaaatagaatagctaagttaattgccagcactgtctattgactttctgtcacagcaggtaaaagcataccttccccgctacaccatgatcttatgtttctccctgtgttttttccaattgtagcacactttttaattaaatcagtaatatttacatgattatgactctgcaaatattattcactgctaagtcatatggtgttttcactgtgcctctgcattccatgtccttcatcctgtctctgaaacagttctgaaatctgagcacttctgcaattctcctggatcttcttttttcctagcctacgttagtttatctatccaaatatcgttaagtagcctctgggtgctctgtttgctttcacatccattattttttagcatgaagctaattttctgactatattcatttgcctgttttctaacagctgttttcccccaagtattgtagcatttatcacatgcctttcaaagatattttccatctgcgaaaacacatctgttcctttttatgtttgtgtggggggcaactttctttggccttttgtcatcctagttcaatatagcgtgggtttccctagatatgctcaatgtctgcttttctgggctaactctttaaagtcttttggtatctcacgtaactgctgtcttgtgtgggatcgcctgagtcctagattctgtgtttccttctgtcctgttatcgtctctagttgtacttgaacacattttcctgtgtggagatgttaaaatccctcctctttgatagagagtacacctctaggttgaatctaaatgttgtggttctgaagacattttgcagttgtgctcttattacagtgttgttcttgaatctattgccagtgtgtgatacgttatttacaaccaggttttagttatctgcggaagctttttggaatctctctctctaaggttctgaaattttataacagcttgttggggatcttttcattttattgaggctactaaacctgcagactatctcttcttgagaatttttttttattttctctgttacttttttactgatagtcttgttattcagatgctaggctgcttagaccaatacgcctgcattgatttttaattttttcccttgtatttttttcagtttgtctttttattctagttctgggatattctgtgactttatcctctactatttctattgaattttatattttttgagagtgttttaagatttttttttaaagttttgctcctgattttgactggtcctatcaattccttttttctattgttttgatctcttttcttggaggcttccctccaatgtgtggtggtccctggcctgctttatttggaagcaggatttctgttaactgatagcactcagtgtgaggccttagaagcctgactagcttttcatttgggagacctcagtgtattatctggggatctttattgaagacatttcagtttcttctgagaaggatctcccaattttctgcctggaaagtaaaagcaggcctggaaaggaaaagcagagttagcgaagaaagttggagttccatttttggtgtacagttttctttatatctcaggtttaagccatggtatctctgagccagaaattctcaggtttgatatatccagagaacacacatctaagtttcttgtcagatggaaggacaggtggacttggggctctagttagagatttgcaactgaacttgctggctttttttttttttttcacattttaccctactttccaaagtgccatttgcctgtaagttcacaacctgcctttagttctgcaagacaaactggctcgcttctgttccagtcactttctgtaggcaccaaagttgtgtttctgtgttatttaccactcctttatctactttttatgtctcagcatttattagaaattatctctgtcaaccttctgtgctggtcatgggtgtaacctttattttatgactgatgaggcttccggagggagacgaaataaatttgtggtcaatctattatatttaatccaaatttaggacctgtgtttaaatcaaagtctaatttgagtataattaatgatattaagccagagaattttttaaattaatgtatctataataagcatattacacttttctcctaaggccttgtttaatattttcattcaaagtttatccactgccatatacttcccattacttcacaacatagatggagctgttttcctgaatgcccaaaatgttagaaatatttaagttaattaagatttgttcatttttagcctggtcaacatagcaagacctcatgtctacaaaaaggttaaataaaaaattagccaggcctggtggcatgcacctttcgtattacctactcaggaggttgaggcagaggatcgcttgagctcaggagtttgaggctgcagttaactataattgcaccactgcactccagcctgggcaacaaagggagaccctgtctcggaaaaaggaaaaaagttactaattctttaaaaacctatctaaaatttgtcctgcccaaaaggagagtgaaaaatatgaactttagtctttgttttattttatgtttgctgagaaaaatgctgtactttatttatttatttattatttccataggtttctgggggaacaggtggcatttggtgacatgactaagttctttagtgatgatttgtgagatttaggtgcacccatcacctgagcagtatccgctgaacccaatttgtagtcttttatccctcaccctcctcccagcctttccccgaagtccccaaagtccattgtatcattcttatggctttgcatcctcatagctcagctcccacgtatgaaagagaacatgatatttggttttccatgctgagttatttcacttagaataatagtcttacttccatccaggttgctgggaatgccatgaattcattccttattatggctgaggtggtattcctcatatatatatatatgtatgtatatcacggtttctttatccactcattgattgacgggcatttgggctggttccatatttttgtaattgtaatttgtttgagttcctcatagattctggataatagccctttgtcagatgtatagactgtgaagatttcctcccactctgtggttgtctgtatactctgctgattgttccttttcctgtgcagaagctctttagttaagtctcacctatttgtttctgttgcatttgcttttgtgttcttggtcatgaagtctttgcctaagccagcgtctagatgggtttttccaatgttatcttctagaacttttatggtttcaggtcatagatttatgtccttgatccatcttgagttgatttttgtgtaagctgagagttgaggatccagtttcattctcccacatgtggcttgccaattatcccagcaccatttgttgaatagggtttactttcttcactttatgttttaggtggctttgttgaaaatcagttggctataggtatttgagtttatttctgggttctctattctgttccattggtgtatgtgcctatttttatatcagtaccatgctattttggcgactatggccttatagtatagtttgaaatcaggtaatgtcatgcctccagatttgttgtttttgcttagttttgttttggctatgccggttcttgtttggtccatataaatttcaggattgttttttctagttctgtgaagaaggatggtggtattttgatgggagttgcattgaatttgtagattgcttttggcagtatggtcattttcacaatattcattctacccattcatgagcatggggtgtctttccatttgtttgtgtccatgacttcattcagcaacgttttgtagttcccaacggcatatcaaaaaataatcgggccaggcacagtggctcacacctgtaatcccagcactttgggacgctgaggcggacggatcatgaggtcaggagttcgagaccagcctggccaacatggtgaaatcccatctctactaaaaatacaaaagttagccgggtgtggtggcgctcacctgtaatcccatctactcaggtggctgaggcaggagaatcgcttgaacctcggaggcagaggttgcagtgagccaagatcaccgcactgcatattccagcctgggcaacagagcgagactccatctcaaaaaaaaaaaaaaagataatccaccatgatcaaatgggtttcataccagggatgcagggatggattaacatacacaagtcaataaatgtgatacaccacataaacagaattaaaaacaaaaaatcacatgatcatctaaacagatgcagaaaaagcatttgacaaaatgcagcatccttttatgattaaaaccctcagcaaaatcagcatacaagggtcacagctcaatataataaaagccatctatgacaaacccacaaccaacatgatactgaaagggggaaaagttgaaagcattccccccgagaactggaacaagacaaggatgcccactctcaccacttgtattcaacatactactggaaggcctagccagagcaatcacacaagagaaaacaataaaaggcatgcagatcagtaaagaggaagtcaaactgttgctgtttgatgatgatatgatcatatacctaggaaaccctaaagactcctccaaaaagctcctagaactgataaatgaattcagcaaagtttcaggagacaaaattaatgtacacaaatcagtagcgctgttataccccagaagagaccaagcttagaatcaaaccaagaactcaaccccttttctgatagctgcaaaactaaactaaactaaaataaaatacttgggaatagacctaaccaaggaggtgaaagatgtctacaaggaaaacaactttagtatttttaatgggttaaaatgagaggcagcaggtacagcagaagaagtcagtgcgtgggcatccgcatccaatgggtactgcacctttgatggtaaggctttggttttgacttactaaattactaggtacgattattttctagtttttgtcattaaaccttaaaactactaagtaaccccttccatttcttgttaaatattgtaaaatttcatactctcatttatgctgcctgatgttagagtatttgtttctattttgtgactaccttaaataatacctataaagagtaaactgttagtagtgtttttgctgtaattaaatgtagtaagacttaccttccaaatgataactgaattgtcaaacacttgtcgaagttttggatttactcaaaattctatgctcagcagctggaggtaggaagagtaagggccctcccttactcttatggagaggcatactttctcacaaggggaatactctgcaggaattagcatcttgtaagcagtggtgaattcaactaattagtgtataaaaatacattttttggtgtggctgccgacaaagagatccaagagggtagatggagtcgagcttgctgaagcaaggaaagagaaaagcagtattctaggcagagagcaggggtagagcaggaaaatggctaggtgcaggtcagatgatttatagaatgcaattgatcaagttttgaagtgaatgcaaagtattctccgagagtctcatttgagtcatgtcttggcagtcttatttaaacatgaagtgaaagttagattttttaagttgtcatttgttttcagggtgtgagagaatatgtaagtgatactctttttatcctccacataagaaaataggactagagaaacctatggcttcctcacttgttggtggcctagcagccctggcacacagagcctctgaatctgaaacacttcttttgtaacaatatcacctgaaataatacatttaggattagtaatttagtaaatgcattagtcttgtattcactgcaataaaatgctcttgtagcaggattatttaatacattacattttattgtagtaaataaataatagaagggctgggcgccatggctcacgcctgtaatcccagtactttgggaggctgaggcaggcagatcgcgaggtgaggagatcgaggccatcctggctaacacggtgaaaccccgtctctactaaaaatacaaaaagttagccgggcacggtggtgggcgcctgtagtcccagctactcaggaggctgagtcaggagaatggcgtgaacccgggaggcggagcttgcagtgagccgagatcgcgccactgcactccagcttgggcgacagagcgagactccgtctcaaaaataaataaataaattaattaattaatagaaattctcagctgctttttattgctgcagaaaaaaaatgaaatcttattttaaacttttctttttttttttttttttttttttttttttgagacggagtctcactttgtctgccggcctggagtgcagtggcgcgaactcggctcactgcaagctccgcctcctgggttcaccccattctcctgtttcagcctctcaagtagctgggactacaggggcctgctaccacgcccggctaattttttgtatttttagtaaagacggggtttcaccatgttagccaggatggtctcgatctcttgacctcgtgatccgcccgcctccacctcccaaagtgctaggattacaggtgtgagccaccgcgccccgcgaagccgacttttcccattatttttaacggtaattcataaaatccttgttaggtttgatgacaggtaccatattaagggcagcattttataacccatatcttaaacatcatctctggaagttgagagcctccaatgggttttctatagagtgcacatgataccacactcaggcagttcatggagtgtaagacatatcttagtgctttgtcatttgacattttaactgagaaaataatacactttgataagtttgacttacacttcccttccccttcaggtatctactgtgcgtttcagtcaacaatacagcttgtgttcgacaatattccttgatgacagcacagccatcagcattatcttacaatgacaataatatcgtgagtacaactatgctgccgagggacagattcctttattctaaaattatttcagtcatttggttgtccttttcagcaatcagtttaagaaattggagtcaaccatatattgatatccagattctgaatattaagtatcagtttctcttttaatcttagacgtcgtggtggaaggaaaaatcagttagcaaagaagcaatcccagaaacagtgtatctttttgatgcctttatgcctttagacaatgttgaacagagtgagaaggataggttccctttattgaatgttttcttgtggaaacttagtttttcaatgcatcataggcctaaatcagtgtgcactactttggacattatccttggaagaaggaacagcttttcttcttctggcaacgcagtgtatctgcatttgaatttctcccattgtgcatgagcacctcatgggccacaaagatgcgctttgagagcaccctgagatgaagtttattttaaaaggaacaacaaccaacaccaccaccagctccacaggggctgtccagtgtacattattctcatcttcttgggttattagtcttgatttttagaacacagtttggaaagtgctaatttagaatattaatgtctttatctttaatttaacttttcattctgtacacataactagcttataaacaattttgtttcaaatgcactagcctttttaactaattcaattgtcaataacttttacttcaattaaaagtggaaagtttacactcataataatgtcactttcctccctcccttttaacaatagttgagaggaaattgtgtttcgaacaaaaactggactcaaactctgtctcaagtcctgagctttgggacctattgagtaatcactaaatgtctgtagtcagctaagtctcttaaatctctgagcacacatacacaaaaattactttgactagagtccctggcttcttctgagttccaaagattttcatatgttagcatataattcaaaagcagctttgaagattaattttgctgaaacaaatttcgtgcttttttcctcattattctactttttagaagtctacttttgagagtatagtaagttttaatttgccaccagcaaatttgagaaatgatcatttggtgtattcactattggtgaaataaagttattgaacaaattaattgggcaaattggcttcaagaagatattttgaaaaatgttttatcatgaatcagtagtgcactgttgtcagtgggataggtggaactcgctgagatcacttatgcaaggtttttttcaaaacacaagtctgcaaacacatgtatcttcccatctccactttccctctatctctaggcactgagaagccttttaggaaaatcgggatggatgtgaggcatctttctgtgaagaaaagcatcccagaagattctgattttcaccccaactcaatcattccaaactttgctgctgattgaaatcacctgggaaacgtttaccaagaaccttgatgcccaaagccatacccaatactaattaaattaaaatgtctcatgtggaagatgaggcagatattaaagcttctcaggcgattttaatgtgcagcaaagtttgacagccactgcttaatttgagtttaggatgagaaactgctcctatttggtgggaccttgggcaagtcagttttaaggtctgtttccctgatctgtaaaacgagtgttgaattaaatgtcacataaggtcattggtcctttccagcatgtaactttaaattctgtgattttaaaattatttcagagatgaaaactacttgaagcactatagacatatccatcttacctgctaatgttacaggctttttaaaaagtgctaatattgtgtagacctattagtagaattgagatttgccttccctcagttgttttgaggctcactctacaaaattagctgggtgtggtggcacatgcctgtaatcccagccacttgggaggctgaggcaggagaatctcttgaacccgggaggcagaggttgtggtgagccgagatcacaccattgcactccagcctgggcaacaagagcgaaactccacccaccgcccccctccaaaaaaaaattatctgggcatagtgacacaaacttgtagtcccagcttcttgggaggctgaggcatgagaatcgcttgaacctgggtggtggaggttgtgaggagtcaagatggcaccactgcagtccagtctgagcaagagagacagactctgggtcaaaaaataaataaatacataaaataaatcgcatgggacgaaaggtttcgtgggtagaaaagcatgtaacaaggaaatctgttattatttatatattgtaatcaccaacagaaacgcgtcttctaacggcatatttccttgcattttggttctcatatttttgtaaaaaacaaagaaatgaaaacaaagtgcccttatggtactgttctgaactagaagatttgaatttcagggccactaggagagtttcctctgccccccttttaaaaaatgtcttcaggcctaacaaatgttaacatctattgttatgaattttttttccttccacagtgtgaccttggagatacctcatcatatcacacaaaggtgagctttttagaaacctgtcttgttattctagctaagtactttgcaagatatcaagctcagtgttaggcacatcataagctgtattgtgcctactaaaatattgaagcaaattatttgtattttctttgttccttaagactctcataattcttaaatgattgagaatctcaaagagtatgtgtttatattgattatattgatatttagtgtggtagaattatacaattgaaattttttcaaaatctatttttagtttagatttcacagccttaccactgttgatattatgggctagataatgctttgttgtgaggactgtcttgtgcattgcagagagtttagcagtattcatggcctctaccaactagatatcagtagtaacccatgacccaggttataacaacagaaaatattccttgagaacagtattgttaacagaattttttcattgaaaaataacttttctacaacaaaaagttgagtaaaaagtgcgtcatgtatttatattatttaaagtctctcatgttgagcttaataggagacaaatggattctctagagctttctttgcaatttgctttaaagcagcaataagaggttgggcacggtgtctcacgcctgtaatcccagcactttgggaggctgaggcgggcggatcacaaggtcaggagatcgagaccatcctggctaacacagcgaaaccccgtctctactaaaaatacaaaaacttggctgggcatgatggcacacacctgtagtcccacctattctggaggctgaggcaggagaaccgcttgaacttgggaggcggaggttgcagagagctgagatggtgctattgcactgcagcctgggtgacagagcaagactctgcctaaacaaacaaacaaaaaaagcaataagctggtggggcgcagtggttcacacctgtaatcccagcattttgggaggccgaggtgggtggatcacttgaggtcaggagtttgagaccagcccgaccaacatggtaaaacccgcctctactgaaagtacaaaaaatggctgggcgtggtggtgcatgcctgtagtcccagttacttgggaggctgaggcaggagaatcgcttgagcctgggaggtggaggttgcagtgagccgagatctcgccattgcaccccagcctgggtgacagagagagactctgtctcaaaaaaagaaaaaaagaagcaataagatgaccgaacctcatgcaaatatgtagttggtagaaggtgtatttttaaacttttcagacagttgtgggtatttgttaacactaaatcaaaacttcacaagtggtggtttcttaaattagttacggtggcattttacatattaataaatttattccatcagtactcattgatctttcttccacagtaaatggatcttttgctccatacttgcatttataatatcatgcattagttacttggaatatatcggtttatgttttattgtgtcaaaaatcacttttagtttaaccaccaatcttactttaacacgcctttaagtattgaatagctgccaagcctacagtagaaggaacaagtttttcaaagtccacaggaaagcttaaattttatcattgggaacaaatacgtatttcccttgaagtgacaacctctcacttcatttatttttgagaatgatagttgaactggttttttagaccgagtttcactctgtcacttggctggagtgcattggcatgatctcagctcaagcaatcctctcacctcaggctcctttgtagctggcaccacagatgtgtggcaccacgccaggctaattttcttatatgtttgacagtgacagggtttcgttatgttgcctaggctggtctcgaactcctgaaggagctcaagccatctgcctgctttggtctctcaaagtgctgggattttacaggcgtgagccactgcgctggcccagttgtacttttaaataaaaatgatgttctgtgaaaaaagtgatttttcagttcatagttaaatcacggattctttaaaaacaaaaaaaaaagcgcttctggttaactttccacttattcagaatattagagacatgtcaagatttaacaacattaatttttactgcttcatcaaagacattcttaagaaattcaggctatgttttttacctgtaggggacagtgaagaatagaatgactactaatgtaattggtaccactgccttgatttatgctgagaaaccagccattgtacccacttttgcttttatataatcatggcaagtgtcaacgaaagagcaggcaatggctttgtattactttcacaaatttttaaaatttttcatcagctttctcaggtttaattagtatgattcagaacagtgttggccaggcacagtggctcaggcctgtaatcccagcactttgggaggccgaggcaagcggatcacctgaggttaggagttcaagaccagcctggccaacatggtgaaaccacatctctactaaaaatacaaaacttagccaggagtggtggcaggtgcctgtaatccctgctacttgggaggctggggtaggagaatcacttgaacctgggaggcgaaggttgccatgagccgagatcacaccattgcactccagcctgggcaacaagagtaaaacttggtctcaaaaaaaaaaaaaaaaaagaacagttatgacctcttaggccttctggaaggggtcttcgggatcccgagaggtccacacagcacatttggagaaccactggtttatacacaggcacaatgcattagttttacaaagtttaaagttcatcaaagactggcgtcttaaaaaggcagatgagtttgtcattcaaacaacagaaagtacataaatacatcatgagagtatactacagagaactaaagagaaaggaagctaggaaatctgaatcacatttacatttattaaagtttactactactgctttgtagaacattcttgtgtttcaatgtgtggttagaagagtgaaaatatgtttggtttattgccatggcctgttagggagagtcaatactcacgggcatttctgactggttatcatataaaagacttcacggtacaggccatgatgtgctgagaaagaagaagtcaggaaaccctctgcaagtcaggatccaggagaagaattcgtaaaaactgctttggtaaacaccaaagcacacaggaggcagtattttactaaacaaatattatactaagatattaacagtttttgaagtaacgcgctttcttattttatagagatgcagatagatctttgagcatacctgatgaacagttacactcatttgcggtaagtggcacttttattgaggttgtattttcatcgtacacttgtatctgtttcatgctgaagtcaaagccatctttttttaaatcttccccatttcatgttgcatttagtcatcttaagtgttgtaaaaagaatgtgctggagtaagaactgatctgcagctctgtttagttagtgagctagtatgagtaaatatactatccaaacaacagaaaatgtatctttttttttttttttttttttttttatggactctctttctgtagcccaggctggagtgcaatcgcgcgatcttggctcactgcaggctctgcctcccaggtccctgttcaagcaattctcctgcctcagcctcttgagtaactggaattacaggcatgtgccaccatgcccagctaatttttttttctttttttttttttgtaaagacagggtttcaccatgttggccaggatggtcttgaactcctgacctcgtgatccacccacgttggcctcccaaagtgctgtgattacaggtgtgagccaccatgcctggcccagaaaatgtatctttttaaaaggtaattgtgagctgtctataggaccctgcaagccactacccaatttttgaagccattcctccttctgttccacacaggtttccaccgtgcacattacgaagaacagaaatggaggtgggagtttaaataactattcctcctccattccatcgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggcgtgctcacctattattcaagcttaggtgattatatgaagaatattcataaaaaagagattgaccttcagacatctaccatcaaagtcccaggaaagtggccatccctagccacatcggcctgcgcacccatctccagctctaaaagcaatgacctatccaaggacatggacaccgggctgggtgactccatatgcttcagccccagtatctccagcaccaccggccccaagctcaacccgcccccctctcctcatgccaataaaaagaaacacctaaagaagaaaagcaccaacaactttatgattgtgtctgccactggccaaacgtggcactttgaagccacgacatatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcacccgcctttcccgtgtgcgatctctggagctggatgactggccagttgagctcaggaaggttatgtcatctattggcaatgacctagccaacagcatctgggaagggagcagccagggacagacaaaaccctcagaaaagtccacgagggaagaaaaggaacggtggatcctttccaaatatgaggagaagctctttctggccccactaccctgcactgatctgtccctgggccagcagctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacgagtgcgtgtagttctgttttatttgactacagtctccttggtgcaaaaacaaaatgggaaaaataaggataactcagaatttcaaaaggaaatcacaaattcagcttataatagcattttcagtacttctcataaactaagtaaatacacaaaatgttgatttttctgaccataagacatattttatgtccttttgccgaggtggatgtgttagtctcaggccctcctggccacattgcccaagtcacacaggcttctgtattatgtatttagataagatgtgtgaaaatatatttgaaaaaaagttcataaatttgcattgatttttgtacacatggcacctctttttcattttttttttttttttggacgatgttttgctctgtggccccagctggagttcagtggcgtgatatctgctcactgcaagctctgcctcccggattcacaccattctcctgcctcagcctctcaggtagctgggactacaggtgcctgccaccacacctggctaattttttgtatttttagtagagacatggtttcaccatgttagccaggatggtctcgaactcctgaccttgtgatccacctgcctcggcctcccaaagtgttgggattacaggcgtgagccaccgtgcccggtccgtggcacctctcttaatttataaattgaactgaatgtgaagtaataatgtcagctagttgagataagagggttacagatcggctgggcgcagtggcccacacctgtaatcctagcactttgggaggcctaggcggactgatcaccaggtcaggagattgagaccatcctggctaacatcatgaaaccccatctctactaaaaaatacaaaaaattagctgggcatggccgggcgtggtggctcacacctgtaatcccaccactttgggaggccgaggcaggcggatcacaaggtcaggagatcaagaccatcctggctaacatggtgaaaccccgtctctgctaaaaatacaaaaaaaaaaaaattagccaggtgtggtggcgggcacctgtagtcccagctacttgggaggctgaggcaggagaatggcgtgaacccaggaggcggagcttgcaatgagctgagattgcaccactgcactccagcctgggtgaccaagcgagactccatctcaaaaaaaaaaaaattagctgggcatggtggcgggcacctgtagtcccagctacttgggaggctgaggcaggagaatggcatgaactcaggaggcaaagcttgcagtgagcagagattgtgccactgcactccagcctgggcaacagagcgagactcggtctcaaaaaaaagaaaagaaaaagagggttacagatcattgcacatggaaaatattcccagcagtaaacacttccattaatgtgatctacagcttttaaaaaggagcatctcagaataagatggtggtacaatttgcttattgagaaaggaaaaaaaaatacatgagtatattacaaagggaaaagaaggaatgtgatttctcatgattgaaagcttgatttagattgcatacagcttttgctacccaagaccaagcagctctggcaagacagggtggttttccgaatgccagaccgaggtgccttatgaaggcagctgccgatggttccagatgtagagagataggtgatgcaggagggaaagctggattggaaaagggagagttttgtagacgggctatgctcattgtgcctttgaaagagcagagctggcagcctgtagtcatcatttggatatacaggactagagcatgaatctgatgtagagctacagaatgaagagcaacagcagctgtttaaataccgagaaagtgtgtagaatgaaattggacgagccaagcatggtggtttcatgcctttagtcctagctactttggaggctgaggtggggaattacttgagctcagcagtttgagtccagcctgggccagatggtgagaccctgtatcttaagaaaagaagaaataagaccaggtacagtaagtatctcatgcctgtaatcccagcactttgggaggccaagttgagaggactgctcgagtgtaggacttcaagaccagactgggcaataaagtgagacccatttctaccaaaaaaaaatcaagaaattagctggacatggtggcacatgcctgtggccccagttacatggcatggcaggctgaggcaggaagatcacttgagcccaggaggtggaggctgcagtgacccatattcatgccactgcactccagcctaggcaacagagtgagaccctctctcaaaaacagataaagtggacagaaaataggtcggtaaggactaatcatttaagggacaagcccccagaagagtggctactagagtgggaggaggaaaagcagaaggagaaagagttgaagataggcgaggctgtggtcccagtgctgaattctgccaagcagtgacttgattcatgaacactcactggatgctgactctgttgctcttctgagtgctggggtagaggagaggagaggtggagcacagttcttgcttttatgagcttatgttctaggaagttcaaacaagtattttttcaggtagtatgaaatagcaggaagaggaagcaggctaaagggacacagagtgattgggggctattttaagtagaatgataaggaagagcctgtctagagagctatttgaacagtgacctgactgaagggacaacagaaagcagtgctgacattacaggtagcaggatgactgccaagacagaaacgcatttcatatgtgttcgaggaacaaacagcaaggtgaccagcatggggagagtgaagaatgagggaaaccttgaatgagaataaagcaattccatcttggatgctaatctgcaatattctgattaatcccagttccaacaattcatctacgatttctattttatctttttaaaaaaattattttttattttttattttttgagaccgagtctcactctgtctcccaggttggacttcagtggcacaatctcagctcactgcaaacttcacctcctgggttcaagcgattctcctgcctcagcttcccgagtaactgggattacaggcgcctgccaccacgcctggctaatttttgtatttttagtagagacgaggttttaccgtgttggccaggctggtctggaactcctgacctcaggtgatccgcccaccttggcctcccaaagagctgggattgcaggcgtgagccaccgtgtctggccatacacatccctgctgaagcccgcattacccttcccctatgctatagaagccctgggtcgggggggtgggggtgatggcacagggatccaccatcttatcttggtgccatccctgacttgccttctgttcataaacgcctattaaatgtttctttctgagaaactggatttgtcagcctctttctttggtatctcaggttccttggcctttgcgggtaggtttatatagacctgctcagcacaggacaggcagtttctcaaaaaattgaaaatagaattaccaaatgatccggcaatatcacttctgggtatatagccaaaataattgaaagcaaggtctcatagaaatatgtgtacactgatatttatagcagtggtattcacactcgtcaaaagatggatgcagccgaattgtccataggcagatgaattgataaaatgtggtatatacatacagtaaaatattcttcagccttaaaaaggaaggaaattctaacacatgctacaacatggatgaacattgaggacattatgctaagtgaaataagccagttagaaaaagacaaatactgtgttctttcacttatgtgaagcgtccagactgagtaagcaaactaatagaaacagaaggtagaacgggggttgccagggacatggggaagggagaaaatgggaagttgcttagtggatatagagttttggttttgtcagatgagaaagttccggagattggttgcatggcaatgtgaatatactctacattacccaacccaagggctctccttgacccctgttccaactgccacttagaagtggttaaggtagtaaattttatgtatattttaccacaattcaaaatagaattattattattttttttattataattttttgagatccctcactctgttgcccaggctggagtgcaatggcaccatctcggctcactgcaacctctgccttctgggttcaagcgattctcctgcctcagcctcccaagtagctggaacttacaggcacatgccaccatgccaaactaatttttgtatgtttagtagagacagggtttcaccatgtttgccaggctggtctcgaactcctgacctcaggtgatccacctgccttggcctcccaaagtgctgggattacaggtgtaagccaccatgcccagctgtcaaaatagtttttttttgtttttttttttgtttttttttttttttttgagatggagttttgcttttgttggccaggctggagtgcaatggcaggatctcggctcatggcaacctccacctcccgtgttcaagcaattctactgcctcagcctcccgagtagctgggattacaggcatgcaccaccatgcccagctaattttgtattttattttagtatagatggggtttctccatgttggtcaggctggtctccaactcctgacctcaggtgatccacccacctcggcctcccaaagtgctgggattacaggtgtgagccattgtgcctggccttttttttttttttttttttttgtgatggaccttcgctcttgttatccaggctggagtgcaatggcacgatctcagctcactgcagcctctcctcctgggttcaagcgattctctttcatcagcctcctgagtagctgggattacaggcatgcaccaccacgcctggctaattttgtatttttagtaggtatggggtttctccatgttgatcaggctggttttgaactcctgacctcaggtgatccacccgcctcggcttcccaaagtgttaggattacaggcgtgagccactgcgcctggcctgaaaaaaaatttaaaagtttgagaaaatataaaatttttatagtctccatgtatttctcctaagatctttccccctatgaggggaggaaagaggaattattataacacaggaagatgtttaatactcaggattttttatatcatcatatttaaagtctttttctgcacagctaaatctgattccctgctactaaatctgattgagttagcaactaaactaactgatttggtagtatctatccagatcacaaacagaaatattgttaagactccctcaaaaaggagtttaacctcaataggtaactcctcctaactatagttctaaattaatgaaacacagtagtcatttaacaagatactagtatatatggccattggggtatatgggacatgctacctcaaaatatgacaccttggcatttgagaaaacagaagcagaaaggtctctctgacctttccctggcccttctcctctgaagcaggacatagaagaatcctctaaccctctctggagtaggtcataagaacttaattccagtcctccctattcccagaggaaaggagcctccttatttgtaaagatgcagagaatgatctgaccacacaggccttgctgagctcccccagcttattcccttcaggtcacacccctttcatctaatcgtgcttctccaaaactgtccgcttcttcatcagacagcatccaattgacacaggatttcctgtttctcttgagtttttctttctgaaggctcctgtgtctggtaaaacttatcttacgtaaacttgcacacttttctctggttaatctgtcatttgttctaagggactcgaccatgaacctagcgatggctgagaaatcatttcccccctagccggcctaactcatttgaaggagcatacactattgtgtgggagtcatacttattcctaaccattttgaagagattcatctttaaattaatatattacattaaatgtcttccttcagaaaagacaatcttgtgaacatcgcctttggtgactgaacatcacgagatataaaacaggtagaaaaagaaaatatttggggtggctctaactcttaaatcccatgaaataatcccctcttctttagcagaaacctcagctcacctcctcatcactgctgaacaacagggcagatgctttctttttggagagcttggaggcttttgctttctcttgtctttgagcttgtagagacaatgtctgcttcttagcagctgtacccccaaaaagattatcctagaaaagcaaatggcagaaaggtaagacaactttataatcagaaaacataggatgtcctcctatatcaaactttaaggaagtaagtctccagtcaggtatacaaataacaactctggtgaggaaaaaccacaaaatgctagtaaatcccaaactacagccttttctcactgcacccatagaagggaaagagattaccatagaactcgaaggcagaacagctgtgaataagcaggagaacaacatgcgaatgagatcatgaagtacaaggagaaactgagccccatccagtcgccctgtgggcaagtgcctctctgctcatttcaggtggttacagcctgcgatgggcacgggagcccccgcagcagccagaaactcacactgttgtctccacaaatgagaaaccagaacaatggctgaaaggagagaactgggggtctgtctccactcctttacaggtcagaaagacatacacctgggatggagggaaggcatgacttgtgtttctcattagtttcaaagagattatacaaagtggagaaatagcttactaaataaaattgctggtgtactaagtttaatggcatttgtaaattcttctgtggtcaagcactccccaaaagttatatttattaaggtgcttttattcagataaggggaacaaaagcatcagagggcctgagtctgagttaggatggacaaactcttaacagcaggtgaacagccctggaatgtgaagatggatgaagggagtgtcttcctggatgaagtctcctttaaggagagtgcggtaatgtaggacaggccaggagaataatgagctggtgtccattggggatgctaatgacagagctcacattcactatgcacttattatgtgccggcactctgcatgagcttcacactagtagttacagctgccacaatgaccctactcactgttaagccacatgagcttaaggaaggttaagttacttgccccaggttcctggtttgcaagtggtggagctgggatatgaacccaggggtctgatggcaaagcctctgagctcaccaccgcccagtactgcatgagagttaaggtttgggttgtcttctctcttatttctcttccccactgtgctctctccagccaggatgggaaagaaagacaatggtcaggacatggctgccttctcctttgtatctccacttgatccaaaacattcttgtaggtcattgggtatatgttgatccatcctctagactaaagtacagctcaccctgaatgacacaggtttgagctgcacaggtccacttctacacaaatgttttctcagtaatatgctgaaaattttttttggcatttgcaacaatttgaaaaatcttgcagacaaaccacttagcctagaaatatcaaaaaaaaataaggaaatgctagatatgtcaggaatacaaaaatatataaatagatactatactatttataggttaatcaactgtttgtgttacccatgaggcttctggttaacagtaaggtatcagtagataagtttttgggaagtaagaagttatatatggatttttcactgcaatgtggaagccaaaacaacctcctcactgttaaagggtcaattgtatttctcaaaggaagatttctaaaaataaaacctgtagatttcactccataagaactgtgtcaagaggccaggcacggtggctcgtacctgtaatcctagcacctagggaggccgaggcaggcagatcaactgagatcaggaatttgagactagcctggccaacatgatgaaaccctgtctctactaacaatacaaaaattagccgggagtggtggtgcacgcctgtagtctcacctacttgggaggttgaggtagaagaatctcttgaacccggttgcagtgagccaagattgcaccactgcactccagactgggtgacagagaaagactccatctcaaaaaaaaaaaaaaaaaaaaaaaagaactgcgtcaagaatctaatgtcttctccattgcacagctaggaaaatataaggaagaagtcactgaaataaaaacagaaatatttttgttatataaacttcaggtagcctgactgcttccctaccaccttttgctagtatatgagcctctgggtagaaagttacatcaacaaccgttttctcctaatctaaattatctagtgttacaataacaatgtttacctcttcatcttcatcatcaaacagggaaaccgacgtggggagcttgccaggcagcagagacgcaccttttaagttactcgcactttgagaagaaaacaaatcctgttggattgaaattaaaaagttgctggttaacaggaatatcagtttttaaaatatcaggtcagtataaaacacaagtgactcagacatgacagctgccatgtgtctaggcttctttcctgagagggaaggtggctcagacagagtccttaaaggaggcctcagggtctgtgcagggtgtgtgcagtggcgctaaggaggaggagagctacaggatctggtgggctcgcagagcccaggggcttctgtattcccacctgaatgacagaaggcaggaataagtttttgaatcaatttcctacaccatgctaaaaaaataaataaataagaatggcttcccattactgtctaaagaatcagaaattagacagggtcaataaagaaataggagctagattcccaaattaagggacctacaactattttatttcgtaacacccttctttcctaagattatgacttatttctttttcttttttctttctttttttttttgagatggagtctcactttgtcacccaggctggagtgcagtggcgccatgttggctcactgcaagctctgcctcccggattcacaccattctcctgcctcagcctcctgagtagctgggactacaggcgcccgccaccacgcccggctaatttttttatatttttagtagagaccgggtttccccgtgttagccaggatggtctcgatctcctgacctcgtgatccgcccgcctctgcctcccaaagtgctgggattacagacctgagccaccgcgcccagcccacttatttcttttaaataaatacaaattaaatttttatttgtaaatgtttgatagtctacttagttttactacaagtatatgatgttgcaaaccaggataagacctgctagattctgaataaactttcagcctggcactgtggctcatacctataatcccagcattttgggaggctggggcaggtggatcacctgaggtcaggagttcgagaccagcctgggcaacatgacaaaaccctgtctctactaaaaatacaaaattagccaggcgtggaggtgggtgcctgtaatctcagctactcaggaggctgaggcaggagaattgcttgaacccggaaggcggaggttgcagtgagccgagatcccaccattgcactgcagcctgggcaaaaagagtgaaattttgtctcaaaaaagtaaaaaatataaaaataaagaaattttcaaaacgttataagacatcagcttatcctgcaaagaaagacctacaaattgagctacatgaagtagaaacataaaatgggacatctaatcccttgggaagagaaacattaatacacaagagctgaacaattaaataggacaagaacatattttctaagacctcttctgacagtttttttttttttaatcatggggttgatgtctactcctcaaacatagacctaatgagttcactaagtgagatctcctccacacagtgtttttcccctgtgctccccggagtcccatgggtttatttagatagaagaggccacaaggggaattccaggcatcccgtgtccctcctgcatgttacacaatggcaagagaaagggttctgctgttctaagaaaatgaaagtaaaccaaagcaaagaacaaaaacaaatgtcaacatcacagttttggacccttaactaatacttttattggtactgcaaaaaaagacacttccattacctcaaatatgttcccctaaaatgacttcacagggcaagcttcagccccacacttgagatacagagaaaggagtcaggacgcattcctttgggtccaaagctttaactcttacttagactgccttagttttacttctccttgcctcagaatctgaacaatatccaataaaaacattcactctatgatgacacacatgaggcaaagcctttggtagggttttcacacaagtctgagagtacatttacactcccaccatcaagaaggggagcctatggcccctccccatgaacctggatgggccattgtgaccatcttgaccaacaaatgaagcaaaaggaccaccgttgacttccaaggctggaacacagaaggcaacatggcctccactgggctctctctgaggactctcccctacagccctgagccagcatgtaagaggaccggcttccctgactacatgctgggagccacacagggctagtgagagatgtcccaggggccccagtgcccaggtaccagacatatgagtgagctgaccctcagcccagccaccttcagacacaagagaccctcagtgacaacggcctagctaagcccagtcaaactctcgaagtatgagataacaaaactactggtgttataaactactaggttttggagttacttgtttcatagcaacaaataaccagaacatctcgtaagtcactgaaattgctcacatttggttttcttgtctaatcaacaattactggatggcttaccacatgccaagcactggtattaaggacagggtgctggggatacaaacagggaataaaaagtcctgtccttgtggcacttactttagtgggaagtagagacaatgaataagtaaatatacattgtccctggcaacacgtgctgtggtaaacagtgaaataggaaagaggaccaggagcacagcgtggtatgtgctagcaggcttcctgttgtgtgtatttcatcagcgaggcctcacagagaaatcgaagagtgaggaagaaagctggattctgggaacagcattcctcagagtggcaggggccggtgcaaagaccccgaggtgcaggtgtgggtgacacaggggatccatgagcataagacggtggaggccccatcatgctgtttctcaggggtcagggttgtgacttgactggactttggttaattgccatgttttgtacactcgccttcaatgaaataatagcctcaaaggtattctttacgtcaagggcaatcactatacttccaaagggttccatgttcatccttgctgtgagtgcaaagcccaaccatgacagcctaacctagagcccacagtttcttgaaatacatgtaagtttctgccatgtccacatgtttttctgtaaaaggggcttattatttcccattacatttctcatacaggtctccgatctcctaaaaggccaacttaaaattagatctaagacgacctaggcctgagagattcaggaaaagcagtgaaattctgagaggtggttctaaggtacctggagggaccaaagcaacctgtgaaccagggtcccacaggctgttagtggtctcagtctcgacaagacagatggctatgccagaacccatctgctacagcattaagccacggtctagttagtgagaatgtgaataaaggaagtagcatggtgacctccactctggtgcaagctcctcatcacatcatgagcccatgaacagtttacaatctgagcatcctaaaaagagagtattttcatcccaggaaacgtaaatacagtccaacccaaaagtgaaaagtattgtaaacatattgctttctaaaacccctgtgctctcaagagattattttttattcatttatttattttgagacgaagtctcactctgtcgcccaggctggagtgcaatggcgtgatctcggttcattgcaacttctgcctcccgggttcaagtgaatctcctatctcagcctcctgagtaattgggattacaggctcgcaccaccatgcccagctaatttttgtctttttaatagagacagggtttcatcatgttggccagcctggtcttgaactcctgacctcaggtgtccacctgccttggactcccaaagtgctgggattacaggcatgaaccaccgctcctgacctctagagataatttttaaagaactggagtacttaacgaaaagtcttataactctgctgagaaaaacctgattcagaaatagtttctatgtcatatccatagactaatacccacaactaaggaaaagaataccatacctcagagtcctcctgatcctaaaataagcctttttgagtgtttgtttctgacgagggcttgagatttttgctggaaggtaaggtaacctttgttgggggaaaagaaaagaaaaagaaaaattaagcattaacaaataagatacccagaaaagagtgtttactcaatcaaccatttagaaaatgcacggagtctctgctgtgataggcagcaagccgagggggctgttaggagaacagcaagacaaacagaggacacatctggtgtatcagggagcaggacacacagtctgggtcaatgggtgcacagatgggacatatgcaatgagagacagcatggaaagacaggctgcctgacaggcctaccaggttctgaatgctgggccttagggggtcggcaggagaaagtcagggtttcacagccaggacatgacatgatgagacaaactgtagaaagaggagggaccagctgtacaggacagcagtgaaaggtcaagcagtcaaaagggcttaaaaactgctggggacacacacactggccaaatgcaggtcaatctgagcaccaaaaactatgatggtctggccaacatggtcaaacccagtctctacaaaaaaatacaaaaattagctaggcatggtggtgtgcacatatagtcccagctacttggtaggctgaggctggagaatcgcttgagcccagggggttgaggctgcagtgagctgtgattgcaccactatactccagcctgggcaatagagcaagaccctgtctcagaaaaaaaaggaagaagaggaatgatggtaatggattatcatctacactgaagaatgaattcatgatcccaaagcaacactaaaaattagggaagcagaggacgaggaaactctttattcagaagataccaactaataagaaatatagaattaaaaaagcagtggtttatgaccactaacaggttaactgattcaggaaaagatcatcagtggattttcaaaacactgagtaaaaggctgggagagaacaggtattcacactgttcagctatcactttagagatcaacttagcaatggcaaaagagaacagggtacctttccaatgaagcagtgtggtgggcaccctaacaaccaagtgacaaacgtgtctgaatgaggcagacagtggacctgatgtatcttgggaggtgatccaactggaagtgcacaaccctgcctgcttgtattcttgccaaaactgctcaccctgaatcaattcatagaaaaataatcaagcaaattcatgcgacacattctacaagacaagtggctggacgttaaaaaaaaaaaaaaaaaagatgtgggaggtgttgcactagattaaggagaccaaagagacaggacaaccaaatgcaatgcagacatactgcctgaatcctgggtttcttaaaacaaaacaaaaaaaatcaaaatacacaaaaatactataaagcaggggtccccaaccctgggctgcagaccagtccatgacctgttaggagccaggccgcacagcaggaggtgaggtgagcagcaagcattactgcctgagctcctcctcctgtcagatcagtggcagcatcagattctcataggagggcaaacgctattgtgaactgtacatgcgagggatctaggttgcaagttgcactctcctaatgtccccaatgccaaaaaggttggggaccgctgctataaatggcattttggggacaagagaggaaattacaatataaactatatgtgagataattttaaatctgtattctatttgttggggtgattttacaaagacattctgggacaactggagcaattctaatacagactagatattagattctactatagaattactgttagtctcacagctgttgataatggcattgtgcttatatggaagtcttttcaagagaggcttaatgaaatatttaggggtagaatgtcacaatgactacatggaaacagttccatgcagcaaacagttcaaacaacttacatgcaaatagttcaggaaaaaaatagatatgtaacaaggtttacatccataaagtgtttgccaaaaccctaagaactgatcaatctgggtggcagttatttgggtgttcactgcaatgttctttccactttctgtttgaagttcttcaatatgaacgtgaaagggaacagtacttccctctgggttccggatgaattattaaaatgctgcagatcaatgctcctgcgttaagtcctccctcctgctcgcctttttttctgctcttgctttattttcatctgtctgactcaccgtggcttctggcgatgctacggctttttctttgaacagatctccttcttcatcaccaaagatatcagcagtggattggactttgcctttaaataccaaggcataaaattacaataaggccggaaatcctaccacaaaaaatcctaccacaaaattcatagaataaaaaattcttccctcccgaagattaatatgaaagttacattgtttcttggttacttataaagaaatagtaagtggaactatactcttcccttcaaatttttcaaagagtgtattgacagctcagttgaaagacagaacaaatagtttaaccatgcagctgacatgcttatccaagcagcagtctcctgctgcggttagagaagcttggactaacttaaaaggtgaagagggatctagaggaagaaagatcacttaagaggaacaccaagtcaatcatctaaggaatctgagaaatgaaggctgggctcctgctttaaaaaaatcaaactgggctgggcacagtggctcacacctgtaatcccagcactttgggaggccaaggcgggtggatcacgtgaggtcaggagtttgagaccacactggccaacgtggtgaaaccccatctctactaaaaatgcaaaaattagctgggtgtggggcaggcgcctgtaatcccagctactcgggaggctgaggtaggagaattggttgaacccaggagacggaggttgcagtgagccgagatccgccactgcactccaccctgggtgacagagcaagactccatctcaaaaaaaaaaaaaaaaaaaaaaaaatcaaactgtacaaaagcagataaaagcaaataatgaaattccctcataattccacctgcctactcgaacaacatggacattggaaacagttcagcatacatgcttccaattcccccaaaggatgtactaatgagttaacactagttatttacaaataaggctataaataagaaggtaatttgaacaatgtgtcttaccatttgtattttccacttaatgtacctataaaaccttcccaagtcaacaagcgtagaccccactcgttttaacagtcgcacaatattccactgaatagaagggccatcgcttactctactgatgaatattttcaccacagtaaacactgctgtaccgaatggggcatgcgttgctgaaatgaggtcactgactcatgaatgtctgaagagactaggagttgtcaaagaaagcagcatcaatttactagtgattctaaatcagttctcaaagatatccactaagtgagagccctgtggagctacaaaaagcactactaccttcattcactgtcatcttcaccgagacctgcatgcattctgcatccgtttgcactctttctagattaactaggctatcgttttccctcgtgctttggcttccatccttactttctacacctaacactggaaaaggacagtaagtccagacagtctgcttctaaatgcattctgattccatctattcctatatcatccttttttattttttaaagttgctgaaaatcatgtgcaacttagggatctagggatctacctttcttttctggaagagcagtcaatggatctaagtcttgctattccaagtgtgatctacagaccatgaagcttgctggaaatgtaaattctcaggccccaccctggacctactgaatcggaatcttcattttgacaaaagcctctgggagattcatctgcgcatttaaaaacaaatgatttacaggaatgacttcaggaacacaggacttacatttaagaggaaaaagaaaggagaatgccaaaaagaaaggagtggccaagtggatgaaaaccccatcatgtgaagaaagaccaaggccacctgagctttttggcagagagaagagaagctgggaactaaacggccagcacacaaaatgctgctcatgtaattgactaaggtcagctggaagaaagtatgattaaaactttataattccaaaggtcagaactgcgaattaagcaaaaattatagggataaagacttcagctctctataaggaaaataatcatagtaattagcttacagagcagaaaagattgggtcataaaacagacctcccaggcaccacacctacgtaagtacagacacaacagctcaatgacaggaatgctggggaagggattctggtactataagagatacagaactaggtgagcttatcttccatttaggcaacattctttttctggctgaagtcctagacacagaggcaggaacaaatacctgttttggaaggtttgctgtggggtgtcgagaaaaagtcgttatcatcatcaccatcatcatcatcaaacaggccagtgggagggggaccataggggcttttccttggagtgggctgctcaggcttctgtggctccttcagtgatggaacggaggcagcacatccgtgtctcctgtgagtgaagggacaagacagacacagctgtgagccagtgtgggcctgttgaatttacagaaaaaaattatcacccaccaaaaactttccatttcagttaatccacaaaatgcattaacagggcccaatagcctccatccattactgctacagaacatctcacaatggagaatcaccaggtcactcaaacacaaaaaagtccaaggccactgagctctaggagaataagagctaatatcagtaaatgagctctttctatacgctgctcaaagccctttgaagctcccaggtacttcctcatctccagccaggctttagaagatgataattttgaaatggaaaaaacagtatttgtgtagtttttagaaaacaaacctgttatgttacctaaaaatacagaaacagctcctgctaggattttctttccaggtttggatgatgaagactctagaatgagaaagcaagggataaccatttttacaagggaaataactttccttgctattttcttcctgaaatatgtgcaatgtaacacacagctagtaccagaccttttgaaactactttttcctgaacaagccattttaaaattctttagtattttcttctctactgacatcaggacttttttggggggattgatacaatctcagctgtgactccaatggaagagcatgctgaccgtcatcaagccacagcagtgggtcagctgggggacaccaagggaggaggtgagcacagctggcagaggcagggacagcatgaccggggctcccccaaacagttccacctctacccattccagttggatgagaatgaacgagtgaaaaagaacagcaaaaacatgtgagtcatcagtaaaaaaataaagacataagagcaaagggggaaaccaagcaagtcactgatgccaaaacgtggacagcagaatgcagaggagcccgcacagcacgcacaaggagcggcttccaaggcccagctctgatgcctgtgcccgggagactcggcacttagaatcactaattcccaagtcccaagaactaccacaaacctatggagtaacatttgtaggttaaaaaacatatttatatttgtgttttttaaaaactgcaccaatgggacaggtgcagtggctcatgcctgtattcctagcattttgccaggtctaggcgggtgatcacttgaggataggagtttaagaccagcctgtccaaccgtcgtccaacacggtgaaaccctgtctctactaaaaatacaaaaacaaaaacaaaaacaaaacctgtgcagatgattttaatgcacactgggttggggaattactggtctccaacttatatacagaatgttaaaaacgtttctttaaattaaacttcattcaatgaaaatcatcctcaacattgctctagggtacttttcttgtctgactttttatgagttctctcctaacaaagaggcaagactgtggtatgggtttaccggtggtactgttttttccaagacatgaattagtgaagatgaattactttcaactggaccgcagtaaaaacaacagcttcctgcttaacacagaaacaaggcttgggaacaacctcagggttccatctcctagtgagaaagacagttttggaactctgcacacggagacgcagctgcccagccccagcttaccctccttaacagaggctccagcttgccgatcctggggggcttccgtgaagaggtcactctggttgaaataaggtatatgacaaagaattcaaaaaaccaggagaaagcatagctgcatgtgaggattcctaaggaaaaataacctacaagatttaaagctacatatttactactctgccagaaaatcagttgcaaagtgataactatggcaaaatcagaccctaaaataatttaggcctgtccaggaattaaaaacaaacgtggaagacaacagataaggcaagaaacaatcacctagtaaattattcacattaacacgtgcacatcttctcctcacctaacaaagcacagaaggatacggcatttctcactctgtgattcttagttcaaaatgtcccaaaatatgaaaatagaagcaacttccaactgagaaactgttttttccccactaaacaagcaaagcctatttcttccctgtggacccctgacacagctagctgcagggagtgttgctgagtgccatggactcacctcctcgtcctcatcatcaaagagccccttgcccccactgaacaggccacctccagagccaaatggcgagaagtcctcgtcggtcagcttggggggtgcgaataagttatcctcttcatctagcaaacagaaagcaatgttttgcaaggagtattaaagacgggtccggaactcaaattcctgggttggcgtctgcaatgtctccaaactggcatgaagtttatctgaccctctttatcgaagtgtgaggcagtctgacgaatttcacactaaccccctggcacagtccactgacaccctcaaaagactctctgggcctccactctcaagtctgtccatgtctgcggcagacagcattcattctctaggccagcaccctggatctagatttactctgaagcaagcattcaggtcagatgccacattcaagacccattccccaaccaatctgggggaaggaagggcagaataaacaaagggacctgcagactgacacagggacaagtggaatgtaatggacatggctgtttaataggaaaaggcctggtgtatcctttattgaaaacaaatgctagagatccctaagtttctatatttctaaagaattctagaaagacaagaaatgattgctgtaaaatctaataaatcaaatctctacaggaatttttactccacacccacatatcctcccagcaccccaaaacatgccttccaaggcttttgtttgtttgtttttgagatggagtcttgcactgtcacccatgctggaatgcagtggcgcgatcaaggctcactgcaacctctgcctcccgggttcaagtgattctcctgcctcagcctcccaagtagctggtactacaggcacccgccaccatgccaagctaatttattgtattttagtagaaatggggtttcactatgttggccaggctggtcttaaactcctgatcttatgatccgcccacctcggcctcccaaagcgctgggattacaggcgggagccaccacgcccagcccagaggctttagaaaagtaaatggagacagacccatttgtcagaaggaaaacagcatgtaaagcagtacttcatgaattatgtaagcaacattcccgagtcaaagcctcctaaaataacagaattgagggaaaaggcccaccgtccgaaggagttctcctttccttcttctcttgagtgtcttccgaagttttgcttctcctgagggtaaggcttgaagaacagttcacagttttaatagtactaagtcctccctcagtatacgcatcctggttctttccacgtctgtcatcctcataactcacagctaagagcaagacatctgcctttcatctcagctgcactgaaccccctgccctgcccacagtgggcactcaagagtctctttgtaaggcagaaggcttctgctttcatcccaggctcatgtgcataacaggattgtatttgttgaaagaattattatgttatctttctactctcttataactagaatatgctatatagcacattcttacgtgttcaaaatataggagtaaatattcagccaggaattcttaagctgttgcccatggttctctggagtttccattagtcccctgaaattatatgtaaagggttatctacatgtgtacatgtacgtttttcttgtgggtccacagtgttcagttatctaaaggagctcattaaccaaaaaaggaataagcactacaatttaaattatatgtagcaattactaataaatatatgtggtaattactaataaaaagagaaatccgcctttggtgaagccagcagagggccctgcactacccctcccctactccccatcaacgcggctggggctcacttgtcggctcctcgtccactcggcccacggcatcccccttgatgcgggcagccagctcatctgcaaacgatgtaggtctgcttcttttctacagcaggagaaatcaaaagaatcgcttttttgtaacaaactagtacacttcactttggacacctaacaacattatgtatacaagagcaaagaaattgaactgaggagaaaactgagtttaattaaatgaacttaaacatatgtaccctatacagctcacccaaggaatgggactcaaaatgttccttcaaagggagatgctctttatttccttatttttttaatacttgactttaatacttaaaaatctaaataagaaaataagaaaaaggtcatgggcagggagacaggagcactatggtcttcaaactctggaaccagacatattctgaatgatctgactcataaaatcataacatctggacaagaaagtggtacttgtgaggcaatttgagatgcttgccattattttccaaagtgtagatgaaatgacaaatatgcaaaaatgagagatgtacaaagtaagtcacaataaaaaataaaaaaagtcattggttctaaaaccctgccaagtgatagcaactacagccttccttacaggtctagtattttcttcaatgtcctcaatatctttctcctccttctcagagtcagcaaaaaggtcacagccatcatcatcctcttcctcatcactcacttgtgtgatgtgctaagagtataaaataccaaattagaactactagttattaagctaaagaagagatactgccacttagcctttaggctcctccttcaaaatcgtaacagctgtttaaaataataatcataatcacgatgcagtaagttataaagcaaaagatgtgctggaacaaataatacacaagatttacttcaaatctaaataaaaatgcaatctttaataagaatgtaaccacaagaatataaaaagcaaaatattaaaatatcaaaattgtctgttactagagaaatatttttatttatttactttttttatttttgagtaattttgttgttgcccaggctgcagtgcaatggggtgatctcgcctcactgtaacctccgccttctgggttctagcgattctcctgcctcagcctcccgagtagctgggattacaggcacctgccatcatgcctggctaatttttatatttggtagagattggatttcaccatgttggccaggctggtctcaaactttttacctcaggtgatcaaactgccttggcttcccaaagtgctgggattataggcatgagccaccacacctggcctattactagagaaatataaacaaaatcagtatagtcttaccttagtaagaatactgagtaatagttaaaaggtaaaagctgtaacaattagagagccatccaaggtaggtcaagcaaaaaagtgccaataacaaatccagcacgataccgcgccccctctacatacaagcatttctatggaaacagatatatttataaaagcaaagaaaaagacgtggaaagacatgctcccagagcatgatcccagttacctctgaagagtatgcagagaaagaaagtactggaaggctcaaacttagcctcatctgttaagttctaatttttccaaaggtacacagtagtatgtataacaaaaaaaaaattttgttcaatgtttgaatcaatgaactgtgccaggcatgttactaaaagcactttattatctaatttaatccttacaactttgaggttagctgcagcacacaaaaccaacctgttgcataagctagtgcttttactcactatactgtactgttttgaaaaacagtttgtggccaggcattgtgaatcacgcctgcaatcggagaactttgagagggtgaggcaggtggatcacctgaagtccggagtttaagaccagcctggccaatatggcaaaaccttgtctccactaaaaatacaaaaattagctgggcatggtggcacacgcctgtaatcctagctacttgggaagctgaggcacgagagtcacttgaacccaggaggtggaggttgcagtgagccaagatcgtgccactgcactccagcctgggcgtcagagtaagactctgtctccaaacagacaaataaataaataaatgggctactctattcaggagaaattcagattttggagtcacaatgtttcagtgataaattccagggtgtgggacgtagattaagggtgttaagttcgtggccactgaagttacccatgatggtgttacataaaatccaagtttggtaattggctcgcctcaattttaccaaccaagttccaagttctaaagtgtgtatgtgtgtgcgtgcgtgcgcgcgcgcgtgtgtgtgtgttttaatgaatgtgggggaagtggaagaggttggtagatggtgacttaaaaatgaagtccccttaagactctaagactgtttttgcagacagcagtcttagtcttcttccaggctggagtggagtggtgcaatctcggctgactgcaaccttggtctcaggggctcaagcgatcattccacctcattctcctgagtagctcgaactacagatctatgccgccatgtccagctaattttttttttttgtagatatggggtttcaccatgtttcccaggctggtctcgaaccgccttggcctcccacagtgctgggattacaggtgtgagccaccacgccagcccagccttagtgttaacactgttataggttactgtaacatattggctcacagtgtgtgttctcgggtctgcctctttcctggttacctaatcataagtaagttacttctcctttctgtacctcagtttcctcaactataatttggaaataatatttcctccctcatagtcattgtgtgaattaaatgaacaatgtataaagtggtaaatactgaacacttgataaatgttagctattattaaaggagagactgatatttaaatgattacaatacaatgtaataccttaggataaatacatcaaaaacaacttttttccttatttattttacagctttattactgatttccctctaaaaagagacccaaataaatgtggagcgactcattatagagtaaggaatcacaaagtaccatagtcacgtaacaaaagcaaaaaaaaaaaaaaagcaattgttttacctttcaactgctgatgttatgtacaatctatcacaagaagcatagctgtgcattcatgagctgattgtattaacctctagaattttagaaacgagcacatctaagcatgtggatactctcttaccttacaaagtaaaagcaagcattttctattttaaaatttttatatctgtgtaaaacgaagaattcctggaggtcaaataagaaaaatataccaaactcaaaacactattaagtcatgaaacgaagactctgaggtagaagtcaagcaatataatccacaatttcaggtattcccagcaaccatcgcatctcgcaagtaagatgtatttttttttaaagtctcaacttccaaaaaatcaataatccattctgtaaaatcagatgtaaaactatgaccgagccgggcgcagtggctcacgcctgtaatcccagcactttgggaggctgaggcgggcggatcacgaggtcaggagatcgagaccatcctggctaacacagtgaaaccctgtctctattaaaaatacaaaaaattagccaggcgtggtggcgggctcttgtagtcacagctactcgggaggctgaggcaggagaatggcatgaacctgggaggcggaccttgcagtgagccgagactgcactccagcctgggcgacagagagagactccgtctcaaaaacaaacaaacaaacaaacaaacgacaacaaaaaaaaccaactatgaccgacagaagacacccaaacttttgtcgtggtaacacagtaaatgcttttactaaaagctgccaacatttctatcgtaagggggcagctggttgtaaccttaatgtccatattggtcgggatagtaaggttcttgtctgtgttgcgggtaattgttaccgcaggattgtccacgccactgattggatcgattgtcacttggccacccccatctgccgtccctgcctctgaactgtctgctatcttgcaaccgattgtctctgtttctttggttcccaccagctctgctattccattcctcaacaattggagaggactcaggagggcgtttcaagtattcctgatactcctcgtcatcttctgtgaatctactagcaaacatctcttcaaaatttggaacagctttggcagtgtcagtcattctgaaattcccaaagatttgaggcagctgtattgtttaatgtttaggttgtttaaatccgccaagggctgtgtctatctagctcgggccgaaccccgccagcgagacactaagagaccgcaggagaggtggcctctggcccaccacaccgtggaactccagaccaccccagctctccaatgtagcggagacccttccgctagccatagaaaataacttaagtcacttaagctgtacttggggtaatcaggttatttaatgaggtgataactgaggtgactacaaaagaaaagtctgggattgggtgtgtgagcaaggtgcatggggacagtggtatgttctaggttgaaggctcaccctaggccaagcaccgtggcacctgttttacaatatcataactttaatatcacatccttgcaagatatgtagcttcgttttactgaggaaagctcagaaaagttaaataactcgcccttgggcacacatgactggaaagaaattgggatttttattttagtaagtaagttggtcaggcacaagggcgactcagcagagggaacttcaaggaagtgtgagacaacagctggagccctgagctgggagagtggaggacgaattataaagagttttatgcctgccataatgagaagcttgtccttgaacttgaggggaatgctgagagtgcaaaggactttaagcaggccctacacagtggcagccaagcaggtcataaagagcaagatgatgcccaggcagatcagggattctcttatctacagagcgtccgcctaccagctccttcacagcagcggattttgctgcaagagaagaggcagcaggccaggccttttccttcgcccacagcgcctacgtcgaaggctcccaggctggttgctccactggctgcttgaggtcccctctctccagacccgccgaactggcggccggtgctttggccgatcccgcgccgctgcctcgggccttgggcggcagcgccccccgcccaacccgcctctgcagcgttcctggcgtcagcccctatcctccagcttcctccgccccaacctagggtagaaccccaaactccagtcccagtccacttccgcagcttcctcccctcagcatcgcaggtcggatcacgtgcgggttctgtcacgtgacatcaggtcacgtgaggccggtcacgccccgggcagcttggctggggctaggcttccggggctctgcggtcctcggcctgtgctggcagcctcggagcccaccgagccgggcggctgggatggtgagggcggcgggccggagaggggccggcctgggctggggccgccgtccctgccgccctcaggctcagcctctcttctcgtttttttcgctgcagatgaaccggacgacccccgaccaggagctggtgccggcgtcggagcccgtgtgggagcggccgtggtcggtggaggagatccgcaggagcagccagagctggtcgctggcggccgacgcgggcgtgagaggcgggccccggggacgcgagagcggcaggggtgacgcttggcttgcgcgcaggagggccggaccgcgactgcccctgcacctggcccgtcccgttgcctgccctcttaggaacacacgccccgtttagcccccgagaatgccaccctggcagtccccggccaccagggagaggggcagaccctgaccgtggcccagacgcgacgttcccttcatggggtttctggctcagctccatccggaggggagatccgtttccgccacactgagggattgctcgggcactagggaggcgattcctgttgggacctggactaaatggggtgggaaacaagccagtatgtggatatcctttaatgggattcttcaaatcgggggcccaaaaagctcagaactgttcgagtcccaaatgaataggatttttgaataagagtggtggttgattagctaacccttggtctgtgatctctgtagattgacaaccaaagaggacttttaaaaggagacagggttttgccctgtcgcccaggctggagtgcaagtggctcgatcttggctcactgaatcctctggggttcaggtgatcctctcacctcagcgtcctgagtagctgggactataggcgtccaccacacctgtctgatttgtttatttatttaattttagtagagatgggggtcttgctatgttgcccagactggtctgcaactcctggactctagcgataaccctgcctcagcctcccaaagtgttggattacaagcgtgagccaccatacccagtgccaaaaagggattttaaatttttccagaaacgagataggtgtccattagctcactgccactcttttgatgagctttcttagtgttttccaatgtcacttggttttagtacttgtcaaaccagcattccggccgggcacagtggctcacacctgtaatcctagcactttgggaggccgaggtgggcgaatcacgaggtcaggagttcgagaccagcctggccaacatggtgaaaccccgtctctactaaaaatacacaaaattagttgggcgttgtggcgggcacctgtaattccagctactcgggaggctgaggcaggagaatcgcttgaacgcgggaggtgcagtgagccgagatggcgccactgtactccagcccaggcaacagagtgaaactctctctcaaaaaaaaaaaaaagcatttctttcacattctaacactcaaaggtgaaaggaaatgggttcttttttgatgtgacatgcagaatagttacatgtaacattgatactactgtatgtttattttttaaaatagctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatgtgagttatttagttatattataattccttttttgggagtaggagatattgtaattttaaataacttactgttaggttccctcctaaattttggtggaagtgtggttcttggtaattgtagcttttttctctgggattaacgcctcttttttatttgtaaagttttaagtccttttttccaagcctctaaaaaagtctaatgataaaattttcttatacttcagtgcttccatcttttgtcgttttgagagtagtcagcaattgtgctgaattgtgtggcactcacactgcctttgttgtggcgtgatctgtaaggacagctgtttacctggttagaccctctggacaccagcatatggtttcagttgttgattggggtcattctgttctgataaattatattcaggggatatatatgtctgcttgcaatattctcaactaaagtttatgatggccgaacttacaatatggaatcaactgtaaacagattactgagcttaaatctatgtgtgatttctgtctatttactgtttcttctaggtggtaggaatacataggtaaattagatagagcctctcccttggcaaatagtataattccagcatacaaaggaagtaagtatggctggagcagagtggagacttaagagatgaggatggagaggaagcttaggtaacagacctgtgtttctcatagggtgtcccaactttctgaatatcagcattcatttgtggaaaaaggattattaaagtaagcgatctcccgagattgttagatataaagtaataaaattttcagaatcacaaaattattaaaaaagcccaagatttagaatagttaagagaatgccatgtagtcaacttgtgcagcatgtttgtgcattttttaatagctcaagttaaatgccacttcctgtctttttttggagagctatatataaaataaagacattaataaaggtgttagagatctctttgccagttatttcctttaacagcaaaggagtacttatgagtttgaaaaataacaagtattcggccaggcgtggtggctcatgcctgtaatcccagcactttgggaggccaagacgggtggatcacctgaggttgggagttcgagaccagcctgaccaacatggagaaaccccgtctctactaaaaaaatacaaaattagccgggcatggtggcgcatgcctgtaatcccagctacttgggaaggctgaggcaggagaatcgcttgaacctgggaggcggaggttgcggtgagccgagatcctgccattgtactccagcctgggcaataagagcgaaactccgtctcaaaaaaaaaaaaaagtattcaagtaaaatcagtagttttctgattgtttacacagaatgtccatgcttggtcctgactatctcactggaaaagtcagggactctagactcaacttctctggtgtgcacagccccataatgttttcatcaagattaatttggtgtccttttaagcactcctgttcttttcattctgtacttttcttgctggatcaggtagtcagcacttctctgcagtcagtgctgcagcaccagagtcccaaaggatttgggaagtttctttttttttttgagatggagtctcactctgtcacccaggctggagtgcagtggtgcgatctccgctcactgcaagctccgcctcccgggttcacgccattctcctgcctcaaccttccaagtagctgggactacaggcgcgtgccaccacgcctggctaattttttgtatttttagaagagacggggtttcaccgagttagccaggatgatctcgatctcctgacctcgtgatccgcccacctcgacctcccaaagtgctgggattacaggcctgagccacggcgcccggcaagggaagtttactttgtacccagtgtgcctgtaccagattggtactagattggtaccagatcaatacttcagtgggaagaaatggggaacatcatacaatttttctcaatcacagtcttaggtcttatcttttctccagctcttttctagccaagttttcgtagattctgagttttccatgttgtagtttttgtggagtttttttggttttgttttattgtgttttggtaattgttctttatttctgtccaatactggggatttcctgttttccatccatctctccatccctttagccttagcttttttttttttcttccgagacagagtcttgctctgtcatccaggctggagtgcagtgacaccatctcggctcactgcaacatccgcctcccgtgttcaagcaattctcctgcccacacctcccatgtagttgggattacaggctcccgccaccaggcctggctaattttttttctatttttagtagagatggggtttcaccatgttggtgagtctgcttttgaacttctgacctcaagcgatctgcccattgcaacctccgcctcccgggttcaagcagttatcctacttcagcctcccaaagtgctaggattacaggcgcgagccactgcgctcggcccttagtgttaagtcttgatgccccttcgccttccagtctgcagccagaactcttctccggatgtgctggttgccgctgccaaatcttaattacttcccagaccttccataaggccacatgctataggtttttttcatttgtggcaaagcatgataatactgagaaaacagctaatgcataataaaactctgaaaaaatatacttgctgatatatatttgtaagtgatctggctttttttttttttttttttgagacggagtctcactctgtcgcccaggctggagtgcagtggtgcaatctcagcccactgcaagctctacctcccgggttcatgccattctcctgcctcagcctcctgagtagctgggatgacaggcacccgccaccacacctggctaattttttttgcatttttagtagagatggggtttcaccgtgttagccaggatggtctcgatctcctgacctcatgatccacccgccttggcctcccaaagtgctgggattacaggtgtgagccaccatacccggcaatctggctttttaatgttttattttcaatccctgacatcagtacttaggtgttacaattccagcttgaattatggtgccatttggtttcatggtaatttatcagaaacattcaaagtcagataggtttctgggttttattaattagcctcaggggcagccacaaagttgcaaactatattataaagttagtgaaacaatccgtactttctagggcgagaacagtcaggactttttagggcaagagaaattagtaccattagtaaaggctcaagaggggacttggagggagaagaaatactaattaacattggccagtgttctagtgtctaattagaaggcaacacaattctaaaggcttaattatctgttaatttaggaattggatcctgaaatagcaagtgccatagttaatgactttagtttgttaaatgaactggtgagggaggattttttctttttaaagtcaattgtttcaaaatcttagctttgtaaaattaaaaaaaaaattccagaatgaaacaaattaacctgtttatgcccaaggttagaattttttttgtgaaaagccagaccttggcaatgaccttgagcagtaggatatacataattctgacaagcttagtgttccaataatgggacactaggcataaatgggttaattttccagatcatcttcctgttgatttataaaagctgaattttggtcatttttccctccttttctacttttctattgaagaaacagatggagttgctgaaactgtcaagtactcagcaattagagagaaggaggtaaagcccaaaagccttattaacatataatttcctgcacaggtttttccctctccccctagacctgctttattttacataatgccccttgcttttgacactccagccttctcattccttggagatgccatatgccctgctgctacggggcctttgcttacattgcttcctatgcctctaccctttgattgacatctgtctgtcttctaggtctctgctcaattatattacttcctcctggaccctctgcactaggcacaccccctggataaaagcagctgaagcatcacattctttagtagacttcttacaattgtaattttacaattattgatgggatttgatgagttggaccctcccactaaatcaagccccatatttttaacaacaaatatatttgaggggtccagcacaagcctgatatttagggatccagtgaatatttgaatgaatgagagtacgcataaatgaaaggggaccagggctgtgtatagtctgttactctccagccctggtccctttttccccagttcccctctttccccttttaccctgtctccccagatgaggagcaataccaaagatatttaacagtcctgggtatagctatctgactgtaaattgatcacaaaacacatgaagctgtgagtttagcaggtgaggatgaaagaagttagcattggttatctgctggatatgaagtacttgaggatgcatagtcctgctcaccctgaaaagatcccatgggctttaggtcccatgggtttaggtttcttagatgtcatgtttggctttctagctgcaggctgctgatgggtaaccatggtagctgccaggtcttaaagtctcacttttgagatttacttaactttttggagtcctgactttgaaaattaccaaagtaatccctgatctttatagagcaattaggaaaagtaagaaaaagaaaaatcatgtgaaatttcctcagcttgaggggagcctctcaacgtttagcacatatattctaagtccatttcccatgcagacatcaggcttaaaagaattgaacctacagtaggccgggtgcggtggctcacgcctgtagcactttgggaggccgaggtgggcggatcaggaggtcaggagattgagaccatcctgactaacacggtgaagctccatctttactaaaaaatacaaaaaaattagccaggcgtggtggcaggcgcctgtagtcccagctactcgggagcctgaggcaggagaagggcatgaacccgggaggcagagcttgcagtgagccgagatcccgccactgcacttcagccagggtgacagagcaagactccgtctcaaaaaaataataataaataaataaataaataattgaacctacaaaaaatcagctaccccaaattaaccaaccattgaacttttcagtgtatttttttctgttcttgttttttaactttaaccttttctagatgactgtgtgtgtgtgtgtgtgtgtgtgtgtattttcatttgcagcctactttttttcttaatgtgaacttatttaacccatctttgagacttttgtgaatttaatttttttgttcttaaaccgtatcataatttatttaataatcttctaatattaaatgttatttatgaaatgtttcataaatttcataaatgtttcataaataaatagaaaagttcagagagaaaccacaagtgctaagaaaatgtagcacctagcatcagtggttttgtatcttgccacatttgcttcaaaggtgcctacccaccatattcgtccttaactctaatcattttgggtggggattccttggtatctctgcctttttattctttttttgtttttgagacaggatctccctctgttgcccaggctggagttcagtggtgcagacagctcactgcagcctcaaactcctgggctcaagccatcctcccatctcagcctcctgaatagctggctaggaccacaggtgttcgccaccatgcctggccaactttttattctttttacctagagagggatttcatttttatcccttatagataacctttattgtgtagttgttcttttcttcattgactattatgtatgaatgtttgtgtgtgtttatgtgaaaataaaatcaggcctccatggaattgtgggtctgtttctgccctctgctgtttgttttgtttctctgctgtttgacagtatcataatcttaaatactgcagatttctaatgtcttattagggcaagtccccataatctgtttttattcagaattgtcatggttatcaatctttggctttttacttttctgtgtgaatttgaggattatcttttacttatttatttatttttttgaaatagagtttcagtcttgttgctcagactggagtgcaattgtgcaatctcggctcactgcaacctctgcctcccaagtttaagcgattctcctgcctcagcctcctgagtagctgggattacaggcaccggccaccacatcaagctaatttttatatttttagtaaagatggggttttgccatggtttcaccatgttggccaggctggtctcaaactcctgaccgcaggtgatcccaaagtgctgggattacaggtatgagcctcccaaagtgctgggattacaggcatgagccactgtccccagcaggattatcttactatattgtgccacagaatattttattagcgtttgattggaattacatagaattataaatttggtatttgtgactttctgctggaaatcatgataccatgaacattctgatgtttgcgtttatgataattttcatgggagctaaatttcaagaagtagaattttgggtcagaggatatgatcatttaaaagcaacattgtttgatcagattggcagatacttaaagatgggtggacaggagccattgctggcaaaggtttgggtaaggggcacttgagtatgctgctagtgacagggaattctacgcatttgtgcatagaatctgggaatgactattaagatttatttattccctctctaggtaaaatccttctctaggtatataaataaataataaataataaataaataatcagtttcagccaggcacaatggctcacacctgtaatcccagcactttgggaggccaaggccgatggatcacttgaggtcaaggagtttgagaccagtctggccaacgtggtgaaaccccatctctactaaaaaaaaaaaaaatgcaggccgggcatggtggctcacacctgtaatcccagcactttgggaggccgaggtgggcgaatcatgaggtcagattgagaccatcctggttaacatggtgaaaccccatctctactaaaaatacaaaaaaaattagctgggcatggtggcaggcacctgtagtcccagctactcaggaggctgaggcaggagaatggcgtgaacccaggaggcagagcttgcagtgagccgagatcgcaccactgcactccagccttggcaacagagtgagactccatctcaaaaaaaaaaaaaaaaaaaaaaaaaaaaaaaagggcaaaaacaaattagccgggtgtggtggtgcacgcctgtaatcccaattacttgggaggctgaggcaagagaatcatttgagcctgggaggtggcggttgcagtgagccaagatcctgccactgcactccagcctgggtgacagagctagactctgtctctaaataaataaataaataagcaggaagggtaggagagctctaaatatatgcacgtgttagcttatatttgtgttcagagcctcaggaaatgagcatacacaccaggcttaaattgggtattccaaggatcaggttggggatagggagggaactattttaaaatacatctcttttccatgtgcctttatattgacttaaaattttaaaaattgagatagaattcacataccataaaattcagtcctttaaaaagtatacaatttggtggtttttactgtactcaaagttttataatcacggccactgtctaatgccagaagattttcatcagttcatttatattgacttcttatttctttctttgtaaaaaattttaatttcatttcattttatttttgagatagagtctcactttttcacccaagctgcagtgcagtggtgcaatcagggctcactgcagcctttacctcccaagctcaagagttcctcctgactaagccccacaagtagctggaattacaggtgcacaccaccatacctggctaatttttgtattttttgtagagatgaggtctcactatgttgcccaggctgatcttgaactcctgagctcaagtgatccccttgcctcggtctcagagagtgctggccttacaggcgtgagccaccgcacctggcctatattgactttttataacaagcatgttgtacttcggtagtttttaaaacataaaaatgattttaaaaaccaagaatcacagtgatttggcagagcagtgggtcttttctggaaaagagagtcttgcctacccatgctgtcagggttagtcaaatgcccaggctttctggcaagtcagtggtagatttttctctctgctttcatacaaatgggataataaaaatttatcagccattttaagcaactgaatgaaaataagttttgcctttaccattttccttgttcaaaatcctgaagttctagtttcctagttgataaattacatcagttgacattctccataagctggggtcagaatactgtatcattgcccatcaacattattaggttaaatgaaaaggtgtgaaaactgatatcttactgtttttgcaactcttggtttacaacgaggttaaagtttcatcatgtttcctagtcatttgtatttaaattttttttttttttttttttggtgaatggactattctttgctgttagtccatgacccactgttacggacacccacctggtagtggtctcagccctttgctgaataaccatttccttccgcatctttgtccttagttactgtgtgaattcttatattgtgatttatttccaatgacgtgttgaccttttaacattgagtttgcttccatatttagcgtgtatatgatgaagaagtggaggagccagtactcaaggctgaggcagaaaaaacagagcaggtacttgtataaaatcactcttagctgagtttctgactttgaaaagtgtggtggagatcgatgtgttatgtgggaactgggggatggtgggtggggttgggaaagggagggactgctcctgacagcagcccaagaggggattctttcctttgtttctgaaatgtagtatattaactaatacagagatcaaatccttgaattctgatataagaatagagtagaagtcagcaaacttcttttgtaaagggccagatagtacatattacagatttggagggtcacagaggtcatttttttcctgtggcttcctgagttacagatggaccagccttcttcctgagatcttctcacaccagagcccaaaacatagctaagaggttctgggtcacactgacttcttagcactccagcagagatttctttttcttccactcaggaaggcacatggactgtgaataagtttattattggagtagctttgattttgttctcatttattcagaaaatatggatcacctgtaaaggttggccctttgtcagcaattattacttgtaacagatgaagctgttagactaggaaaagggtattcaaaaccagctatagttctgcctgttgccagcatttttttaaaaaagttattttattttattttttatttaaaaaatttttttattttgagatggagtctcactctgttgcccaggctggagtgcagtggcacgatatcagctcactgcaacctctgcctcctgggtgcaagtgattctcctggctcagcttcccgagtagctgggactacaggcgtgtgccaccacgcctggctaatttttttgtatttattgtagagacggggtttcgccatgttggccaggctggtctcaaactcctgacctcaaatgatccgccagccttggcctcccaaagtgctaggattacaggtgtgagctactgtgcccagcaggttattttatttttaatagaactcaaggatttgctagccatttaagtgcagtagtatctggttataccaattcagggtttaatttgaaggtgataggtatttagtgtactatttttaaaaactgctatatatttcatacacattttcacaaactcagtacaatattagctatttaactcagaatcaagcatatccaaatagaaaaatacacaaccaagacaaaaaagttcagttagaaagacttcagtacttgagataaaagactaaaatgctcgtagggtttttttttttttttgcctttggccctcagaacaacactgtgtggtttggttccttctagaatatttgtagagggggaaatgacactaaatatttttcggtatttctcacaatggcacacttgtgtctgtggggactgccattgagaactgctgttgcaggaagaagacacctgagggagattctcagcctgttggtgatatgaacaaaccttttttcttgaatggggcattgttgtagggtatacacagaatagaccggagatgaaaatgacccccttttgatgtagaacagatttataaaataattgtaattgtccagttttttttttttttgtctctttaaactgtaattgaaaaatgagacctctgtgaccttccttctaagtcttaacacctaaaattacccaagggataaccagggctcgtgggatagtcatggtgagtctgagagtctaggccctccagcagtggggaaacagcatgcattcattgttgggatacttctccacacactagttgtacctctgcttttgtagacgatgacccttgagctctggaaccttaggtagtttgatgcatgtccagaaaggggcaaacttgggatttaaaacttgcagtcttactccaaagtctgtgtcaaggcattcagcagaatttgacttttttaacatttttaataagtttttttggagcttgaggctaggctttagagaacattcacagtattcttttggggcagtatcagtatattggagacccatactgcatggtatttattttgtaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggtgaagacattcaacttaaatatttattgcacaactattatgtttgggctactttaattgggcacacgattagtaagtcatggacttaacctctgggaagtgagtatgtcacttagtagtctcacattgactccaccagaaagactcgctttacctgagcactgatggagtacttgtgaggtgcaaggcaacatgtcaagttggggtgcaaagatgcagagcatggcctctactctcgaggtgtgtgttgcagtctggtgggagagaggagacatacatacgaataaccattgtaaatgccctgagagagaattgatttccagctggaattttggggcaaagatgatatttgaattggggtttgaagggtggggaggctcaaaagagacagagagtgttgggaacctgaaattatgtagcttgggctaaggaagactgcagaagaactgaaaggcatttgggttgtttccggtttgggcaattattaaatacaaatgaagctgctgtgagcattcatgtccaggctccctcatagcctagtgagtgttggttgcttgacacactttctcccacattgttcaaagagacaattggggtgacacagagtctctcggtagtgaacacagaaagttaccacagtgatttatagaaagaggccttgtgacacacaaggccttccgaattaaaacatgccacagaaccaaacccttttttttttttgagacggagtttcactctgtcctccaggctggagtgcgtggcacgatgttggctcactgcaacctctgcctcccaggttcaagcgattctcctgccccagcctcccgagtagctgggattacaggcgcccaccaccacacccagctaatttttgtatttttagtatagacagggtttcaccatgttggccaggctggtctcgaactcccaacctcaggtgatccgcctgccttggcctcccaaagtgctgggattacagacatgagccaccccacccagcctgaaccactcttctagtcattctgtagctgcacatttctcttccagtttgagctttgctgagtcacaccaaattgaggcagatcatttggcactgaccagtacacttgctgcttggattttcactgtatgcctttaaaagtcagcagtggactctgggaaatggattgcctggaccacacttgatacttccaagacacacagcactttctcccttttttttttccccttgcagagaaagttgtggaggtacacttttcttttgtaggaggatttggggatgtcttctgagtcagtgagaattagtccaaattaacgctgtctttgccttatgctccattggttgctgtgacgtcgttgaacctttactttaaccttcccaatctttctgttgttgtgtgaaacgtcagaattattctcccctgccccagagtcctttgacaaggaagagatatcattgccaaagggcaatgcctcacaggggacagggcagcatttccttcagcagtggaggtaggaggctgtgcaagggtggagcactttcttgaccctatttttttttttttttttgagacagagtttcactcttgttgcccaagctggagtggcgcaatctcggctcactgcagcttctgtctcctgggttcaagcgattctcctgcctcagccttccaagtagctgggattacaggcatgtaacatgacacctggctaatttttgtattttttagtagagacggggtttcaccatggtgaccaggctggtcttgaactcctgacctcaagtgatccgcccgcctcggcctcccaaaagtactgggattacaggtgggagctactgcaaccgaccaaccctaaatttttaatgtgtgtgtggtgtgggactgacaggagtagacggctgacatgggcagatctccagcatgtgctgttggggccacagtctcctgccctcactctgttttctcatctggtcttattttaccaacttcacttttctaaattcaacagtgtggaaccactagggggtattgttcttctgtttattgagttataatcttttttatttatttatttatttattttgagtcggagtttcgctcttgttgcccaggctggagtggagtgatgtgatgttggctcactgcaacctccacctcctgggttcaagagattctcctgtcttagtctcctgagtaaatgggattataggtgtgcgccaccacacccagctaatttttagtattttcggtagatattgggtttcaccacgttggccaggctggtctcaaactcctgacctcaagtgatccatctgcctcagcctcccaaagtgctgggattacaggcatgagccactgtgcccggcctaatctatttttatattaaaatatatagatatattatgtctcattagtactgctttttaggggacagctcaccagaatgttcagtttctttccttggtcctcctcttcttggaccttatactaggaggttgtacccttttccctgtttgcttgctgctgatagacttttggtaggcttttgccatttttgttaaattttgttaattaggcccttggggagggagattctgtgtgatacagctttactttggcatcttttttctttttttttttttttgagatggagttttgctcttattgcccaggctagagtgcagtagtgcaatctcagctcactgcaacactgtttcctgggttcaagtgattctcctgcctcagcctcccgagtagctaggatgacagttacccgccaccatgtcccgctaatttttttggatttttagtagagacggggtttcaccacgttggtcaggctggtctcaaactcctgacctcaagtgatccacccgccttggcttcccaaagtgctaggattacaggcgtgagccatggtgcccggccttaccttgacatctttacctaggatttgacttttaaaaaaatcagtgaaaaaaagaattttttttttaacttttagtcctgctgtgtttcttattctccaccttcgttatgtagcttgtttgggatagtcagatggaacagggtatcaggtggcacatgtaagtttgttttcaactgaaatgtttgacagcctattcctttcatcatgtacaggatctatacattgatcgtcctttaccatatctcattgggtcaaagctgttcatggaacaagaagatgtaggtcttggagagctgtccagtgaaggtacttttcttcaccaaataattttattccttaacatttcttttttattttaaaataatttcaaattttacattaaagtttcaagaatagttcaaagaactctcatatacccttcacctgggtttaccagttaacatttcaccacatttgttagattgttctctacatatacgtaatattttgtcttgagcctatttgggagacatcatgctcatgccctgttacttctaaatgtttctctgtgtgttttctttttttcttttctttgtctttttctttttttgagacagagtctcgctctgtggcccaggctggagtgcagtggtgcgatctcagctcactgcaacctccgcctcccggatttaagcgatttttctgcctcagcctcctgagtagctgggaccacaggcgtgcaccaccacacctggccaatttttgtatttttagtagagatggggtttcaccatattgtccaggctggtctcgaattcctgacctcatgatctgcccgcctcggcctcccaaagtgctgggattacaagcatgagccaccgtgcccggctctttttctttctttctttctttcttttttgagccggagtttctctctggtcacccaggctggaatgcaatggtgcgatcttggctcactgcaacctccacctcctgggttcaagcaattctcctacctcagcctcctgagtagctgggattacaggtgcccaccaccacacctggctaatttttgtatttttagtagagatggggttttaccatgttgggcaggttggtctcgaacgcctgacctcaggtgatcctctgtgtgtgttttctaagaacaaggacatctcttgtataatcacagtagaattacaaagccaggatattttcctggacataagggtattatccaatctgctgctatgttcacattttgccgtttgtcccagtgacaccctttacagtctctctcttttgttctgtggtccgggactcaatccaggaccagccaccacatttggttgtcaaatcttcagttatcttttaatctgatgccatttctcagcctttctttgctttttatgaccctgacatctttaaagagtacaagcaagttttttttttatttgtaatgaataatttttggggggagagatacttcaagactacataaatatgtaattcctcaccataatgacactttcaattccagtaagtgggtatagatggttttatcaagatctctgtgatgctgttgtatggtggtttgtgattttgagctaaggacattttcttgtgaatattggtgtggtgacccttatctctcttctcaacagaaggctctgtaggcagtgatcgtggcagtattgtggacactgaggaagagaaagaagaggaggtaagggctgtttggtatgaccaggtcacggtgggcagcaagcttaatttaagatgggcctagcaggctaagtaaatagcataactgtgaattcgtaatctgcttccataaagcttttaacagtgatagaagccacattctgagttttttttcccaagggttagatttcctttttgccttatgtacaataatagggaaagctgctttcatctcttccactattatcctctctcccaccttgccaccaaatatctctttcacccaatatatttttgagaagggcagcttagatgttttggtggaatctctgcctgggatatagtctttgagtatattccgtctttgaataattctaagggaaaaaatctacatttagaacttttgtaaactataaaacctagagcaggatataccgaaagccaccacttacattctattttgctgctgccgctagcgctttcatatccacagagcataatttcatttccttgtctagagtttgagtctgtgggccttgactacagttgaatctgtagttgttctttagatgggatattcgttattggaaaggacacagccatgttgcaggagagtcctcgagtatgggatttccgaaaggagacagtgttgtgtatgtgcttttctcttctggttggtccccctttctgcactctccctgcccgcctttcttccagtcctccaaagaaaaacctgacagcaggaaatgagcttttcttaagtaactttcgtataacaaaagcagtgctcattaggggaatcccttgcttttagccaccgatgtggcacttctatgtggcacttcatcaatagttgctcgtagcaactattgatgtccccttcttgggcctaatgaagtagttatttttattttttatttttattatactttaagttttagggtacatgtgcacattgtgcaggttagttacatatgtatacatgtgccatgctggtgcgctgcacccattaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctattattgttggacatttgggttggttccaagtctttgctattgtgaataatgcaaggaaatagagacagtatagtccaaaatgtaaaataacacaaactgactttcagtaatttagttagttaaatgtgcaactctttaaatccaaaggcaagagttgaaagtgcaggtgatgtgaacaaattgttagaggcatttaagtgaaccacaaaaattacatgttaactggaacaacccttcacaatattgccagctacccagcttatctgcaccttgatacttaaggtgaccagtagtcagtacaaagagactgagtgtcagagctttttctccacttgacatagaatcagcctgccccagagacttagacctgcaatcatttctgtgcttctaagtaaagcccatttaacaacaaagccttttcttacccataaaggagtcagatgaagattttgcccatcacagtgacaatgaacaaaaccaggtaaggctcatatattgaaatgactttgtttttacattttaattgaagcatagtatatatactaaaattactttggaatgatttatgaccaagtgaggattttttcatgtatacaatttattttcctttaagcatttcatgtatttaggctaactacctcctttgtatatattttttccaattttgctttatagtttatttttcttagaaaagaagtttcaaagaagtgaaaagcacaattggaaaacagagcctctaaaagaagactcagttacccaaactgaactactttgcatgagtccctcttctgttttaaaattggagacaatctagcagtaacattattgagtattcacaagatgaaaacttcttaccctactgtcttagcacggttatcttaatttttgaatatctaaaggcgtattcttttcatagtgtgcatcgttcattttctgccattttatgttaacattttataaatgtgtccttatttattattattatttttttgagatggagttttgctcttgttgtccaggctggagtgccgtggcgtgatctcagctcactgcaacctccgcctcctgggttcaaataattcttctgcctcagcctcccgagtagctggcattacaggtgcccaccaccatgctcagccaattttttttgtatttttagtagagatggggtttcaccatgttggccaggctggtctcgagctcctgacctcaggtaatccacccaccttggcctcccaaaatgctgggattacaggcgtgagccaccatgcctggcctccttattttaaatagcctttgcagtttgcgttgtaaacttctatacttttaaacatactgagtatgatactgtcatagtctctaaatgtataagggaaagagtttatttctagagttgtatttttgatgtaataatgtattcaatattttcttttcttttttttgagacagagtctcgctctgttgcctaggctggagtgcagtggtgtgatctcagctcaatgtaatctccgcctacagggttcaagcgattctcatgcctcagcctccctgagtagctgggactatgggtgtgtggcaccatgcccggctaattttttgtatttttagtggagtcagggtcttcccatgtttcccaggctggtcttgagctcaggcaaaccacccactttgccctcccagagtactgggattacaggtatgagccaccacgcccagccaatattttcatatatagaaatcctttgcttcggtgaactgtttcttcagaatgaggtggtatagagttatgttaataactcttaatgtctggtggacattctaaattaagtattatgcatgtagattttcctacaatctcatcactggggtgattattttaaatttcttttagttaaaaatttgcatttaaatttcttaactgggaaatatttttttcacaaaaatgtttaactatcaaatgaaggattttatactttctggttgttactgtattttcctggttgtattcataaatgtggttgatctctataattttaacgatcagtctttcttcataggatatttgtttctatggaatttcctattaagatctgtaaatgcaaacagtttttctttccttttttttttttttttttttttttgagacagagtctctctctgttacccaggctggagtgcagtggcacgatattggttcactccaacctccacctcctcggttcaagtgattctcatgcctcagcctcccaagtagctgggattataggcatgtgccaccatgcccagctagtttttgtatttttagtggagatggggtatcgccatgttggcgcggctggtcttgaactcctgacctcaggtgatccgcctgcctcagcttcccaaagtgttgggattacaggcgtgagccaccacgcccggccacaaacagtttttcaaaaacagtacagtatagtgagtaaaagcactagcttatgcaacaggttggttttgtgtgctgcagctaacctcaaagttgtaaggattaaattagataataaagtgcttttagtaacatgcctggcacagttcattgattcaaacattgaaaaaaaatttttttaattatacatagtagtgtgtacctttggaaaaattagaacttaacagataaggctaagtttgagccttccagtcctttccttctctgcatactcttcagaggtaactgggatcatgctctgggagcatgtcattccaagtctgtttctttgcttttataaacacatctgtttccatagaaatgctgtagtgtttgcagagggggcggggcttggtatcatcctggatttgttattctgcgcttttttgcttgacctaccttggatggctctctagtcattacagcttttaccttttaactattactcagtattcttactaaggtaagactatgctgatgatgtttatatttctctagtaaaaggctgggcatggtggctcacgcctgtaatcccagtgctttgagaatgtaatcccagcgctttgggaagctgaggtggttggatcacctgaggtcaggagttcgagaccagcctgcccaacatggtgaaaccccgtctctaccaaaaatataaaaattagccgggcgtggtggcgggtgcctgtaatcctagctactcagagggctgaggcaggagaatggcttgaacctaggaggcggaggttgcagtgagccgagatcaccccattgcacttcagcctgggcaaaaagagcgaaactccttctcaaaaataaataaataaaaatatttctctagtaacagccatttttgatattttaatattctgctttttatattcttgttgttacattcttataaaggatacatttttaggccgggcttggtggctcacgcctgtaatcctagcagtttgggaggctgaggcgggtggatcacctgaagtcaggagttcaagaccagcctagacaacatggtgaaaccccatctctactaaaaatacaaaaaatttgctgggcgtagtggtgcatgcgtgtaatcccagctactcggaaggccgaggcaggagaatagcatgaactgggcaggcagaggtttcagtgagccgagatcgtgctgatgcactccagcctgggccacagagcaagactccatctcaaaaaaaaaaaatatatatatatatatatatttatatatatatatatttatattttatatatatttttatatattttttttcttagattcaaagtaaatcttgtgtattatttcttccagcacatcttttgcttcataacttgctgcatcatgtttatgattattattttaaaaagctgttacttctttgaaggaggagcctaaaggctgacagtatctcttctttagcttaataactagtagttctaatttggtattttatactcttagcacaccacacaaatgagtgatgaggaagaggatgatgatggctgtgacctttttgctgactctgagaaggaggaggaagatattgaggacattgaagaaaatactagacctgtaaggaaggctgtagttgctatcacttggcagagttttagaaccaatgacttgtttttctttttattgtgacttactttgtacatcactcattttggcatatttgtcatttcatttacactttggaaaataatggcaagcatctcaaattgcctcacaagtaccactttcttgtccagatgttatgattttatgagtcagatcattcagaatatgtctagttccagagtttgaagaccatagtgctcctgtctctccacccattcacctttttcttattttcgtatttagatttttaagtattaaagtcaagtattaaaaagaataaggaaataaagggcatctccctttgaaggaacattttatgagtcctattccttgggtgagctgtatagggtacatatgtttaaattcatttaattaaactctgttttctcctcagttcaatttctttgctcttgtatacataatgttgttaggtgtccaaagtgaagtgtactagtttgttacaaaaaagcgattcttttgatttctcctgctgtagaaaagaagcagacctacatcgtttgcagatgagctggctgcccgcatcaagggggatgccatgggtcgagtggacgaggagccgacaagtgagccccagccacgttgatggggagtaggggaggagtagtgcagggccctctgctggcttcaccaaaggcggatttctctttttattagtaattactacatatatttattagtaattgctacatataatttaaattgtagcgcttattccttttttggttaatgggctcctttagataactgaacactgtggacccacaagaaaaacgtacatgtacacatgtagataaccctttacatataatttcaggggattaatggaaactccagagaaccatgggcaacagcttaagaattcctggctgaatatttactcctatattttgaacacgtaagaatgtgctatatagcatattctagttataacagggtagaaagataacacaataattctttcaacaaatacaatcctgttatgcacatgagcctggtacgaaagcagaagccttctgccttacaaagagactcttgagtgcccactgtgggcagggccagggagttcagtgctctggtgcagctgagatgaaaggcagatgtcttgctcttagctgtgagttatgaggatgacagacgtggaaagaaccaggatgtgtatactgagggaggacttagtactattaaaactgtgaactgttcttcaagccttaccctcaggagaagcaaaacctcggaagacactcaaagagaagaaggaaaggagaactccttcagacggtgggccttttccctcaattctgttattttaggagcctgttgactaaggaatgttgcttacataattcatgaagtactgctttacatgctgttttccctctgacaaatgggtctgtctccatttacttttctaaagcctctgggctggacgcggtggctcacacatgtaatcccagcgctttgggaggccgaggcgggtggatcatgaggtcaggagtttaagaccagcctggccaacatagtgaaaccccatttctactaaaaatacaaaaaattagcttggcatggtggtgggtgcctgttgtcccagctacttgggaggctgaggcaggagaatcacttgaacccgggaggcagagatggcagtgagccttgatcgcgccactgcattccagcccgggtgatggtgcgagactccatcccaaaaacaaacagaagccttggaaggcatgttttggggtgctgggaggatatgtgggtgtggagtaaaaattcctgtagagatttgatttattagattttacagcaatcatttcttgtcttcctagaattcttagaagtatagaaacttaggaatctcaagcatttgttttcaataaaggatacaccaggccttttcctgcaaacagccatgtcgattacattagacttgtccctgtgtcagtttgcagatccctttgtttattctgcccttccttcccccagattggttggggaatgggtcttgaatgtggcgtctgacccgaatgcttgcttcagagtaaatctagatccagggtgctggcctagagaatgaatgctgtgtgccacagacgtggacagacttgagagtggaggcccagagagtcttttgagggtgtcagtggactgtgccaggggtttagtgtgaaattcatcagactgcctcacactttgttaaatagtgtcagataaactccatgccagtttggagacacagcagatgccaacccgggaatttgagttctggacccatctttaatactccctgcaaaacattgctttctgtttgctagatgaagaggataacttattcgcaccccccaagctgaccgacgaggacttctcgccatttggctctggaggtggcctgttcagtggcggcaaggggctatttgatgatgaggacgaggaggtgagtccatggcacccagcaacactccctgcagctagctgtgtcaggggtccacagggaagatataggctttgcttgtttagtgggggaaaaacagtttctcagttggaagttgcttctattttcatattttgggacattttgaactaagaatcacagagtgagaaatgccgtatccttctatgctttgttaggtgaggagaagatgtgcacgtgttaatgtgaataatttactaggtgattgtttcttgccttatctgttgtcttccacgtttgtttttaattcctggacaggcctaaattattttagggtctgattttgccatagttatcactttgcaactgattttctggcagagtagtaaatatgtagctttaaatcttgtaggttatttttccttaggaatcctcacatgcagctatgctttctcctggttttttgaattctttgtcatataccttatttcaaccagagtgacctcttcacggaagcctcccaggatcggcaagctggagcctctgttaaggagggtaagctggggctgggcagctgcgtctccgtgtgcagagttccaaaactgtctttctcactaggagatggaacaaggttgttcccaagccttgtttctgtgtcaagcaagaagctgttgtttttactgcggtccagttgaaagtaattcatcttcactaattcatgtcttggaaaaaacagtaccatctgtaaacccataccacagtcttgcctctttgttaggagagaactcatagaaagtcaaacaagaaaagtaccctagagcaatgttgaggatggttttcattgaatgaagtttaatttaaagaaacatttttaacattctgtatataagttggagaccagtaattccccaacccagtgtgcattaaaatcatctgtgcaggtttttttgtttttttgttttttgtttttgtatttttagtagagacagggtttcaccatgttggacggttggacaggctggtcttaaactcctatcctcaagtgatcacccgcctagacctggcaaaatgctaggaatacaggcatgagccactgcacctgtccccttggtgcagtttttaaaaaacacaaatataaatatgttttttttttttttctttttttttaacctacaaatgttactcaataggtttgtggtagttcttgggacttgggaattagtgattctaagtgccgagtctcccgggcgcaggcatcagagctgggccttggaggccgctccttgtgcctgctgtgcgggctgctagcctggctctcctctgctttctgctgtccatgttttggcatcagtgacttgcttggtttccccctttgctcttatgtctttatttttttactgatgactcacatgtttttgcggttctttttcacccgttcattctcatccaactggaatgggtagaggtggaactgtttgggggagccccggtcatgctgtccctgcctctgctgtgctcacctcctcccttggtgtcccccagctgacccactgctgtggcttgatgacggtcagcatgctcttccatttgagtcacagctcagattgtgttaatcccaaaaaaaaagtcctgacatcggtagagaagaaaatactaaggaattttaaaatggcttgttcaggaaaaagtagtttcaaaaggtctggtactagctgtgtgttacattgcacgtatttcaggaagaaaatagcaaggaaagttatttcccttgtaaaatggttaccccttgctttctcattctagagtcttcatcatccaaacctggaaagaaaatcccagcaggagctgtttctgtatttttaggtaacataacttaggtttgttttctaaaaactacacaaatactgttttttgcatttcaaaattatcatcttctaaagtctggctggagatgaggaagtacctgggagcttcaaagggctttgagcatcttatagaaagagctcatttactgatattagctcttattctcctagagctcagtggccttggacttttttgtgtttgagcgacctggtgattctccgttgtgagatgttctgtagcagtaatggatggaggctattgggccctgttatgcattttgtggattaactgaaatggaaagtttttggtgggtgataatttttttctgtaaattcaaccggcccacactggctcacagctgtggctgtcttgtcccttcactcacaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgtatgtgttcctgcctccgtttctaggacttcagccagaaaaagaatgttgcctaaaaagaacataagctcacctagttctgtatctcttacagtgccagaatcccttctccagcattcctgtcattgagttgttgtgtctgtacttacataggtgtggtgcctgggaggtctgttttatgacccaatcttttctgctctgtaagctaattactatgattattttccttatagagagctgaaatccttttctgtataatttttgcttgcaatttccagttctgacctttggtattgtaaagttttaatcatcctttcttccagccgaccttagtcaattacatgagcagcaggttgtgtgccggccatttatttcccagcttctcatttctctgccaaaaagctcaggtggccttggtctttcctcagatgatgttttcatccccttggccactttggcattctcctctcttttcctcttaaatgtaagtcctatgtcctgaagtcattcccataaatcatttgtttttaaatgtgcagatgaatcttccaggggcttttgtcaaaatgaagattccgattcagtaggtccagggtggggcctgagaatttacatttccagcaagcttcatggtctgtagatcacacttcgaatagcaagacttagatccattgactgctcttccagaaaagaaaggtagatccctagatccctaaggtgcacatgattttcagcaactttaaaaaataaaaaaggatggcataggaatggatggaactagaatgcatttagaagccggctgtctggactcactctcttccagtgttaggtgtagaaagtaaggatggaagccgaagtgtgagggaaaacgatagcctagttaatctagaaagagtgcaaacggatgcagaatgcacacaggtctcagtgaagatgacaatgcacacaggtctcggtgaagatgacagtgaatgaaggtagtagtgctttttgtagctccacagggctcttacttagtggatatctttgagaactgatttagaatccctagtaaattgatgctgctttctttgacaactcctagtctcttcagacattcatgagtcagtgacctcatttcagcaacacatgccctattcggtacagcagtgcttatggtgatgaaaggttggaaaccacccaaatacttatcagtagagtaagctatggcccttctattcagtggactattctgtgacagttaaaaagaaaggggtctacgcttgttgacttgggaagattttgtaggtacattgagtggaaaacacaaatggtaagacattgttcaaattatcttcttatttatagccttatttataaataactagtgttaattcattagtacatcctttgggggaattagaagcatgtatgctgaactgttcccaatgttcatcttgtttgagtagactggtggaattatgaggggatttcattatttgcttttatctgcttttgtacagtttgattttttttaaagcaggagccaagccttcatttctcagattccttagatgattgacttggtggccctcttaaatgatctttcttcctctagatctctcttcaccttgtaagccagtccaagctactctaagcacaggaaatggctgcttggataagcatgtcagccacgtggataaactatctgttctgtctttcaactgaactgctactatgcactttgaaaaattccaagggaagagtatagttccacttactatttctttataactaatcaagaaacaacataactttttatgtttattctttgggagggaagaattttttaatctgtgaattttgtgataggatgtttgacgttagtgtcattttatgccttggtattttttacaggcaaagtccaatccactgccgatatctttggtgacgaagaaggagatctgttcaaagaaaaagccgtagcatcgccagaagccactgtgagtcagacagatgaaaataaagcaagagcagaaaaaaaggtgagcaggagggaagacttaacgcaggagcattgatctgcagcattttaataattcatccggaacccagagggaagtactgttccctttcacgttcatattgaagaacttcaaacagaaagtggaaagaacattgcagtgaacacccaaataactgccacccagattgatcagttcttagggttttggcaaacactttatggatgtaaaccttgttacatatctatttttttcctgaactatttgcatgtaagttgtttgaactgtttgctgcatggaactgtttccatgtagtcattgtgacattctacccctaaatatttcattaagcctctcttgaaaagacttccatataagcacaatgccattatcaacagctgtgagactaacagtaattctatagtagaatctaatatctagtctgtattagaattgctccagttgccccagaatgtctttgcaaaatcaccccaacaaatagaatacagatttaaaattatctcgcatatagttcatactgcaatttcctctcttgtccccaaaatgccatttacggcagtgatccccaacctttttggcattagggatataaggagagtgcaacctgcaatctagatccctcgcatgcacagttcacaatagcgtttgccttcctatgagaatctgatgctgccactgatctgacaggaggaggagcttaggcagtaatgcttgctgctcacctcacctcctgctgtgcggcccggcttctaacaggccatggactggtctgcagcccagggttggggacccctgctttatagtatttttttatgttttgattttttttttgttctaagaaactcaggattcggacagtgtgtctgcattgcatttggttgtcatgtctctttggtctccttaatctagagcaacacctcccacatctttttttttttaatatccagccacttgtcttgtagaatgtgtctcgtgaatttgcttgattattttcctatgaatagattcagggtgagaagttttggcaagaatacaagcaggcagggttgtgcacttccagttggatcacctcccaagacacatcaggtccactgtctgcctcattcagacacgtttgtcacttggttgttagggtgcccaccacactgcttcattggaaaggtaccctgttctcttttgccattgctcagttgatctctaaagtgatagttgaacacagtgtgaatacctgttctctcccagccttttactcagtgttttgaaaatccactgatgatcttttcttgactcagttaatctgttagcgggcacaaaccactatttttttaattctatatttcttattagttggcattcttctgaataaagttctttctctccccctccttccccgatttttagtattgctttgggatcatgtattcattcttcagtgtagatgataatccattaccatcattcttcttctttttttttttttttttgtgagacagggtcttgctctgttgcccaggctggagtgtagtggtacaatcacagctcactgcagcctcaacctcctgggttcaagcgattctccagcctcagcctaccaagtagctgggactatatgcgtgcgccaccatgcccggctaattttttgtggagacgggttttgcccatgttggccaaaccatcattctttttgatgctcagattgacctgcatttggccagtgtgtgtgtccccagcagtctttaagcccttctgactgcttgtcctttcactgctgtcctgtacagctggtccctcctctttctacagttttgtctctttgtgtcatgtcctggctgtgaagccctgactttctcctgccgaccacctaaggcccagcattcagaacctgtcaggcccgtcaggcagcctgtctttccatgctgtctctcattgcatatgtcccatctgtgcacccattgacccagactgtgtgtcctgctccctgatacaccagatgtgtcctctgtttgtcttgctgttctcttaacagccccctcagcttgctgcctatcacagcagagactccgtgcgttttctcgattgattgagtaaaccctcttttctgggtatcttacgtgttaatgcttaatttttctttttctttttttcttccccaccccccccccacccccgacaaaggttaccttatcttacagcaaaaatctcaagccctcatcagaaacaaagactcaaaaaggcttattttcagatgaggaggactctgaggtatggaattcttttgcttagttgtgggtattagtctatggatatgacatagaaactatttttgaatcaggtttttctcaatagagttataagactttttgttaagtactccagttctttaaaaattatctctagaggcaaggagtggtggttcatgcctgtaatcccagcactttggtaggccaaggcaggcggatacctgaggtcaggagttggagaccaggctggccaacatgatgaaaccctgtctctattaaaaagacaaaaattagccgggtatggtggtgcgagcctgtaatcccagttactcagaaggctgagataggagattcacttgaacccgggaggcagaagttgcaatgaaccgagatcacaccattgcactccagtctaggcgacagagcgagacttcatctcaaaataaataaatgaataaaaaataatctcttgagagcacaggggctttagaaagcaatatgtttacaatacttttcactttgggttggactgtatttacatttcctgggatgaaaatcctctctctttaggatgctcagattttaaactgttcatgggctcatgatgtgatgaggagcttgcaccagagtggaggtcaccatgctacttcctttattcacattctcactaactagaccgtggcttaatgctgtagcagatgggttctggcatagccatctgtcttgtcgagactgagaccactaacagcctctgggaccctggttcataggttgctttggtccctccaggcaccttagaaccacctctcagaatttcactgcttttcctgagtctctcaggcctaggtcgtcttagatccaattttaagttggccttttaggagatcggagacctgtatgagaaatgtaatgggaaataataagccccttttacagaaaaacatgtggacatggcagaaacttacatgtatttcaagaaactgtgggctctaggttaggctgtcatggttgggctttgcactcacagcaaggatgaacatggaaccctttggaagtatagtgattgcccttgacgtaaagaatacctttgaggctattatttcattgaaggcgagtgtacaaaacatggcaattaaccaaagtccagtcaagtcacaaccctgacccctgagaaacagcatgatggggcctccaccgtcttatgctcatggatcccctgtgtcacccacacctgcacctcggggtctttgcaccggcccctgccactctgaggaatgctgttcccagaatccagctttcttcctcactcttcgatttctctgtgaggcctcgctgatgaaatacacacaacaggaagcctgctagcacataccacgctgtgctcctggtcctctttcctatttcactgtttaccacagcacgtgttgccagggacagtgtatatttgcttattcattgtctctacttcccactaaagtacgtgccatgagggcaggactttgtattccctatttgtatccctaacaccccgtccttaatacctgtgcttggcatgttgtaagccatccagtaattgttgattagacaagaaaaccaaatgtgagcaatttcagtgacttacgagatgttctggttatttgttgctatgaaacaagtaactcaaaaacctagtggttcataacacccatagttttgttgtctcacagttcgagaggttgactgggcttagctaggccgttgtcactgagggtctcttgtgtctgaaggtggctgggctgagggtcagctcactcatatgtctggtacctgggcactggggcccctgggacatctctcactagccctgtgtggctcccagcatgtagtcagggaagccggtcctcttacatactggctcagggctgtaggggagagtcctcagagagagcccgatggaggccatgtcgccttctgtgttccagccttggaagtcaacggtggtccttttccttcatttgttggtcaagatggtcacaatggcccatccaggtttatggggagaggccataggctccccttcttgatggtgggagtgtaaatgtactctcagacttgtgtgaaaaccctaccaaaggctttgccccatgtgtgtcatcatagagtgaatgtttttattggatattgttcagattctgaggcaaggagaagtaaaactaaggcagtctaagtaagagttaaagctttggacccaaaggaatgcgtcctgactcctttctctatatctgaagtgtgaggctgaagcttgccctgtgaagtcattttgggggaacatatttgaggtaacggaagtgtcttttcttgcagtaccaagaaaggtatcagttaagggtccgaaactgtgatgttgacatttgtttttgttctttgctttggtttactttcattttcttagaacagcagaaccctttctcttgccattgtgtaacatgcaggaggggcacgggatgcctggaatcccccacgtggcctcttctatctaaataaacccatgggactccggggagcacaggggaaaaacactgtgtggaggagatctcacttagtgaactcattaggtctatatttaggagtagacagcgaccccataattaaaaaaaaaaaaaaactgtccaaagaggtcttagaaatatcttcttgtcctatttaattgttcggctcttgtgtattgaagtttatcttcccaagggaatagatgtcccattttatgtttctacttcatgtaggtcaacttgcaggtctttctttgcaggataagctgatgttttataacattttgaaaatttcttgatttttatattttttagctattttgagatgaaattatactctttttgcctaggctggagtgcaatggtgggatcttggctcactgcaacctctgccttccaggttcaagcaattctcctgccacagcctcctgagtagctgagataacaggcacccaccaccacacctggctaatctggtatttttacaaaattaatataggctggtcttgaactcctgacctcaggtgatctgcctgccccagcctcccaaaatgctgggattatagacatgagccacagcaccgagctgaaagtttctttagaatctatcaggtcttatcctggtttgcaacgtcatatacctatagttaagctaagtagactagcaaacatttaaaaataaagtttaatttgtatttatttaaaagaaataagtcggccgggtgtggtggctcaagcctgtaatcccagcacttggggaagccgaggcgggcggatcacaaggtcaggagatcgagaccatcctggctaacatggtgaaaccccgtctctactaaaaatacaaaaaaattagccgggcgtggtggcaggcgcctgtagtctcagctactcaggaggcagaggcaggagaatggtgtgaatccgggaggcggagctttcagtgagccgagattgcaccactgcactgcagcctgggcaacagagcgagactctgcctcaaaaaaaagaaaaagaagtaagtcataatcttaggagaggagggtgttactaaataaaatagttgtagctccattaatttgggaatctagcccctgtttctttattgaccctgtctaatctctgattctttagacagtaatgggaagccatgcttatatatttatttttttagcatggtgtaggaaattgattcaaaaacttattcctgccttctgtcattcaggtgggaatacagaagcccctgggctctgcgagcccaccagatcctgtagctctcctcctccttagcgccactgcacacaccctgcacagaccctgaggcctatccctttaaggactctgtctgagccaccttccctctcaggaaagaagcctagacacatggcagctgtcatgtctgagtcacttgtgttttatactgacctgatattttaaaaactgatattcctgttaaccagcaactttaatttcaatccaacaggatttgttttcttctcaaagtgcgagtaacttaaaaggtgcatctctgctgcctggcaagctccccacgtcggtttccctgtttgatgatgaagatgaagaggtaaacattgttattgtaacactagataatttagattaggagaaaacggttgttgatgtaactttctacccagaggctcatatactagcaaaaggtggtagggaagcagtcaggctacctgaagtttatataacaaaaatatttctgtttttatttcagtgacttcttccttatattttcctagctgtgcaatggagaagacattagattcttgacgcagttctttttttttttttttccgagttggagactttctctgtcacccaggctggagtgcagtgatgcgatcttggctcactgtaaccgggttcaggtgattctcctgcctcgacctcccaagtagctgggactacaggtacgcaccaccactcccggctaatttttgtattgttagtagagacagggtttcaccatgttggccaggctagtttcgaactcctgatctcaggtgatccgcctgcctcggcctccctaagtgctaggattacaggtgtgagccaccgtgcctggcttcttgacacagttcttatggagtgaaatctacaggttttatttttagaaatctgcctttgagaaatacaattgaccctttaacagtgtggaggttattttgacttccacattgcagtgaaaaatccatatataacttcttacttcccaaaaacttatctactgatagcttactgttaaccagaagcctcatggataacataaacaggtgattaacatataaatagtataatatctatttatatatttttgtattcctgacatatccagcttttccttattttttttatgatatttctaggccacatggtttgtctgcaagatttttcaaattgttgcaaatgtccaaaaaaattttcaacatattactgagaaaacatttgtgtagaagtggacctgtgcagctcaaacctgtgtcattcagggtgagctgtactttagtctagaggatggatcaacatatacccaatgacctacaagaatgttttggatcaagtggagatacaaaggaggaggcagccatgtcctgaccattgtctttctttcccgtcctggctggagagagcacagtggggaagagaaataagagagaagacaacccaaaccttaactctcatgcagtactgggcggtggtgagctcaaaggctttgccatcagacccctgggttcatatcccagctccaccacttgcaaaccaggaacctggggcaagtaacttaaccttccttaagctcatgtggcttaacagtgagtagggtcactgtggcagctgtaactactagtgtgaagctcttgcagagtgccggcacataataagtgcatagtgaatgtgagctctgtcattagcatccccaatggacaccagctcattattctcctggcctgtcctacattaccgcactctccttaaaggagacttcatccaggaagacactcccttcatccatcttcacattccagggctgttcacctgagtttgtccatcctaactcagactcaggccctctgatgcttttgttccccttatctgaataaaagcaccttaataaatataacttttggggagtgcttgaccacagaagaatttacaaatgccattaaacttagtacaccagcaattttatttagtaagctatttctccactttgtataatctctttgaaactaatgagaaacacaagtcatgccttccctccatcccaggtgtatgtctttctgacctgtaaaggagtggagacagacccccagttctctcctttcagccattgttctggtttctcattcgtggagacaacagtgtgagtttctggctgctgcgggggctcccgtgcccatcgcaggctgtaaccacctgaaatgagcagagaggcacttgcccacagggtgactggatggggctcagtttctccttgtacttcatgatctcatttgcatgttgttctcctgcttatatgcagctgttctgccttcgagttctatggtaatctctttcccttctatgggtgcagtgagaaaaggctgtagtttgggatttactagcattttgcggtttttccccgccagagttgttatttgtatacctgactggagacttacttccttaaagtttgatataggaggacatcctatgttttctgattataaagttgtcttacctttctgccatttgcttttctaggataatctttttgggggtacagctgctaagaagcagacattgtctctacaagctcagagagaagagaaagcaaaagcctccgagctctccaaaaagaaagcatctgccctgttgttcagcagtgatgaggaggtgagctgaggtttctgctaaaaaagaggggattatttcatgggatttaagagttaaagccatcccaagtctttttctacctgttttatatctcgtgatgttcagtcaccaaaggcgatgttcacaagattgtcttttctgaaggaagacatttaatgtaatatattaatttaaagatgaatctcttcaaaatggttaggaataagtatgactcccacacaatagtgtatgctccttcaaatgagttaggccggctaggggggaaatgatttctcagccatcgctagttcatggtcgagtcccttagaacaaatgacagattaaccagagaaaagtgtgcaagtttacgtaagataagttttaccagacacaggagccttcagaaagaaaaactcaagagaaacaggaaatcctgtgtcaattttatgcagtctgatgaagaagcggacagttttgggggagcacgattagatgaaaggggtgtgacctgatgggaataagctggggggagctcagcaaggcctgtgtggtcagatcattctctgcatctttacaaataaggaggctcctttcctctgggaatagggaggactggaatgaaggttttatgacctactccagagagggttagaggattcttctatgtcctgcttcagaggagaagggccagggaaaggtcagagagacctttctgcttctgttttctcaaatgccaaggtgtcatattttgaggtagcatgtcccgtataccccaatggccatatatactagtatcttgttaaatgactactgtgtttcattaatttagaactatagttaggaggagttacctattgaggttaaactcctttttgagggagtcttaacaatatttctgtttgtgatctggatagatactaccaaatcagttagtttagttgctaactcaatcagatttagtagcagggaatcagatttagctgtgcagaaaaagactttaaatatgatgatataaaaaatcctgagtattaaacatcttcctgtgttataataattcctcttttttttaacattgtaggcaagttagtagggggtgaagtggatatataagtcatagatatgttcatgtccttactgaaagcaatttaaaaattctgaagcagattgcaaaaaaaaatgtattaaaagcttatgcggccgggcgtggtagctcacgtctgtaatcccagcactttgagagtctgaggcaggcagatcacttgaggttgggagttcgagaccagcctaaccaacatggagaaaccttgtctctattaaaaatacaaaaaaattagcaggttgtggtggcgcatgcctgtaatcccaactactcaggaggctgaggcaggagaatcacttgaacccaggagatggaggttgtcgtgaaccgagatcacgccattgcactccagcctgggcaacgagcgaaactccgtctcaaaaaaaagcttatgcaacacacatgtgaacaagacacaatgaaaaactgctagtaatccttttactacaaaagtctgagtctggcctttagaaagcgtttaaggaattcccacccagctgtgctcatgccttcacatcaaggaactcccaagcatatataatttgtgttttctactcaaatgtatgaatttatgatagattatccagtttttttcttttaaacattgtcagtgattgttccccctgtagcaacagccagacatcagtgtagttgctcctactagagtattatagtggttcagggaaaataaaaacattacctaaagcttggagcaaaaagacatgcagaagaaagacagccaaggttctagaacaggggcgtccagtcttttggcttccctggcccacactggaagaagaagaattgtcttgggtcacacataaagtgcgctaatactaacaatagctgacgaactaaaaaaataaaaaggttcgtgcataaatcccataatgttttaagaaagtttacagatttgtggtgggccgcattcaaagccatactgggctgtgtgtggcccatgggccacaggttggacaagcttgtcctagaacaaaggctgtcaacttcggctgctcattgggatccatggggaacttaaaagagtgctgacaggccgggcacagtggctcacgcctgtaatcccagcactctgggaggccaaggaggtgggcagatcacctgagattaggagtttgagaccagcctggccaacatggcgaaactctgtctctactaaaaaatacaaaaattatctgggtgttgtggtgcttgcctgtaatcccagctactcaggaggctgaggcaagagaatcacttgaacccgggaggcagaggttgcagtgagccgagaccgcgccactgcactccagcccgggccacagagcaagactctgtctcgaaaaaggaaaaaaaaaaaaaaaaaaaaagaaagagaagacctaacgagtgctgacagtggatcccagctccagagattctgaattaatctggttggggtacagcctcgtcattggagttttgtgatactctctagtggatttcagcgtttagtcactgctaaacattgaggagcacttctcaaaccttcatgtttaggaaatcacccaggcaccctgtgaaatgcaggttctgattcagaaaataggggcggggcctgaaattctgcataatctgctgctggcttgtggactccagtttggtttgcaagactctagactccagagatagagcacttatgcaagtgcttgggagttctttgatttgaaggggtgtgagcatagttgagtagaattcccttaaatgctttctaaaggccacattcagacttgtggtaaaaggattactagcagtttttcattgtgtcttgttcacatgtgtgttgcgtgagtttttacactttttttttcaatctgctttaggatttttaaaattaaaatattcttctctggagttggaagttcttgagttcttggtatttttacatttggcttccttcttatagcctctgtaattaatgttgattccctgaaatagacaagtcgcttgtaatacagtgcagaaccacattgggaagagacatcgtggcaggtgttggaggaggaaatcatgagaagctctgtgaggtcagagagcccagctgtctagatttgagttcaaagaaaagtcttaagcatgagctttcttcaagactgatgcactaagtttaatacttagtttaaatacaacttagtttaacaaatataagtttgattttactccccatgttttataatctaaattgccattggagttttttttcttttttttgagacagagtctcgctctgtcccccaggctggagtgcagtggcacgatctccgttcactgcaagctctgcctcctgggttcactccattctcctgcctcagcctcccaagtagctgggactacaggctcccgccaccacgcccggctaattttcttgtatttttagtagagatggggtttcaccgtgttagcaaggatggtcttgatctgctgatctcgtgattcacccgcctcggcctcccaaagtgctgggattataggtatgagccactgcgcctggcctggagttttaatatatattttatgttttaaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacaggtgagatagtcattggaaggagtccctcactccattaccgtggtaacaagaaaaggaatctgatgcacaatctagttcatcgggtgattgctaatcatggatcacatagtgattgtgccagtgagaatgtctttgcttttcaatggcaccatcttttccctcagtacccggaaatgtttgtctttgtggatccttatctgatttcttccccaatcattattttttaaccatattctttttctttgtttgtcagggatttgagtatcttttgtttgtgatttttctctgggctactctaaagtatgtcaggtttggtcaggattacttaaaagttactttaggccaggcacgttggctcacgcctgtaatcccagcactttgggaggccgaggtgggcagatcacgatgtcaggagttcaagaccagcctggccaatatggtgaaaccctgtctctactaaaaaaatataaaaattagccgggtgtggtggcacgcgcctgtagtcccagctacttgggaggctgaggcagaagaatggcttgaactcgggaggtggaggttgcagtgagctgagatggcaccactgcactccagcctgggcaacggagcaagactccatctcaaaaaaaaaaaaaaaaaagttatttgaatagaaatctgctcagcatttaacacatcctgttaggaggaagttccctgtagagctgtgcagtatcactccaggggctgataacccatagccaacctaggtgcctctccccattaatgctggaactgaagctgctaggatattcagagtgagcgtgggctgtggttggtataacatgctgccagattagcttatgggttcagaattacttccctgcaaatactttttttccttttgaaagcctgacatgattactttgaaattcacctgaatgttattagcagaaagaagtaactgattggacatgtaaatcctatgctttggtgtggttaagcgtcatttgatagattcagaagtacctcaggtttctgtctccaaatactcgaatcttgtcaagcatcaccatttctgcattaggcctctgtaacttgacactcggatgcatctttggtctctgatttagaatataggctctggaaagttgatattaaattctgattctgccagttcctgtctgaataaccttgggcaagttacctaacttccctgtgcctcaatttcctcatttgttaaacaaaaataaaaacagcatttctctcatcggtttgttgggatgatgaggtggaatctaaatgtgaaacgctgagcacaagagctggcacattctgagccctcaggtattgccagttagcatcgtgactgcagggaaatagtacattcctttatttttgttgctctctcctgggacattcttcttcctgtgttgcctggccaccttctttcaaaactaagtgtaagtttcttaagaagccttcccggctgggcgcagtggctcacgcctgtaatcccagcacttggggaggccgaggcaggcagatcacgaggtcaggagttgaagaacagcctgaccaacatggtgaaaccccgtctctactaaaaatacaaaaatgagctgggcgtcgtgtcacgcacctgtaatcccagctactcgggaggctgaggcaggagaattgcttgaacctgggaggcagaggttacagtgagccaagatctcaccactgcactccagcctgggcaacagagagagactccatctcaaaaaaaaaaaaaaaaaaaaaggcctttcctaactttaaacagacaagaaagagaagaaatagggagtagagggcagacatggctccaccttcataccccaacaccctcagctgagcattttctgcactgtatccaggttagcttattcccatgagtgtccactacccccaccccacacaaggtcataaatctggcagtctgaaccccatcttgtttgtgggtcctggttccagccacacaccatacctggctttcaggaatgctttctctgctccagatacatcctacctcctattgttcccgaagttgtctgtcaagttttgtgtatggaaagtaattcataccttcatcagatctcaaaagaagctttacacacacaagaagaagttgaggtgaggatgtggaggaattggaaccctcatacactgctggtgggaacgtaaaatggtgtagtcactttggaaagtagtttggcatttcctcaaaatgttaaacatagagtcaccatatgacataatagtttcattcctatgtatatacataagagaaatgaaattagttgttcatataaaaacttgtacatgagtgtttattgcagccttagtcataacagccgaaagtgtaaacaacccaaatgtccatcaactgatgactggataaacaaaatgtataaccatacgatagactgttcttcagcaataaaaaagaataaagtagtgatgcatcctagaacatgaatgaacctagaaaattttatgttacttgaaagaagctggtcacagaaaaccacatattgtattgttccatttatatgaaatgtatagataaaccacagagacagaaagtagattagtggttgccagggcctgtggggcagggggaatggagagtgatggctcataggcatggcggttctttttggggtcatgataatgttgtgcacttaggttgtagtgatattgcacaactcgatgagtatattaaagaaaacattgaagtatgcactttaaaagagtgaatctggattaagaaaaccattgaagtgtacgcactttaaaagagtgaatctggccaggtgcaacggctcatgcctgtaatcctaactgattgggaggccaagtggaaggatctcttgaggccaggtgtttgagaccagcctgagcaacatagagcgacctcacctctccaaaaaagtaaaaaaattagccaggcatggtgacgtgtgcctgtagtcgtagctacttgagaggctaaggcaggagatcacttgagttcaggaatttgaggctgcagtgggatatgattgtgccattgctctccagcctgggcagtagagtgagaccctgtcttaaaaagtaaaataaatattaaaaatagagtaaatacaaggtgaattttatggaatgtaaattatgtctcgataacgctactaaaaaaaagaaatagaagccaggcacagggtcatttcccagtgctaatcctggccctgtgatctctcttggcaaccgtcttcatgacaattctggaaataggcacgtccgctttgattctttttgtgctataggaagtgggagagaatgttctgcttgggaaggctcaggcatcgtgtgccttgcagcggtaacagctgatgaacctgcactggatagtaacaggaaaggggcaacctgaggcaggagggacagaggctggtgatttgttggagtcagatttcatctatttcaaaggtctttcctgtttgctttcaactgtgtaaggtcaactaatggcttgggtgtttgggtggtaggtggattcctgtaggtgcagtctagaagaaatattgttgttatggtttttgtttttttcatcacacttttccttaatttgaccttttgtttgtttgtgtagccaaaagaagacccagagagtgtcactcctctttgaagacgatgttgatagcggaggctctctgtttggctctcctcccacatctgttcctcctgcaacaaaggtattcttcatctcttagtcccaggaaatgtccttgagtttatgctgcatcagtagtggtacttccccgaatcagctcttcatacctaaccttggaggctgagtcttatggaagaccttatttgcctggtttcagaaagagatcttctgattaatagtattctacagaagaagcacacgtgcaaagccatcattcagtgtcaggtgtaggcacaaggaactgggtctcagaagaggcttgggccccattggcatggaattctgctaacattagactaggccagttaaggcaaaatcattccttttatgagtgtgtgtcgagtactaacactggtcctggtttatattagccagtcagtaaaaaggaaggaaattctcacatgtgctacaaaatgcatgaaccttgaggccgttatactccatcagtggagaaatggtcacacaggtcctagtacagttagactgtggaatactatacagtggtaaaaaaaaacccagggtggagcttattgggatgaaaaacatactgcaggccaaaaaaaaaaaaaaaaaaaaaaagcgtaaacacgtaaacatggtgtaatttaaactttacaaaacaagaaatacacatgaatgcctggaaaccggcctgaaagcatcgatagcacattgttaccagtgattatgtccagggaaaggtatggaatggggaacttcatactctcaatgcctttttaaagcctttttaaggaaggcatttgtgcattactgtggaattagaaataaactccaaacaaaaaatatctaggagatatggaagaagacccttcctgttaaatggagttgctcagcttataccagaagctctcagccctgggccagcatgctgcccaccctgggccccaggctccctgctgctgcttctacggggctcctgagcctttccttgggtgctctgtacttacatctccccctttaaggacatccagtggttgtacaattaaaggagtcaggagatctgattggtttttctttgtaaattataaataaactactctggaggataactgagcaataaattaatgaattttggagcctctggagctgtaaaacttctttcaacctatggtaattatgattgttaaataaaacaaaaggtcaagacacacaacttaagtagctgaatagcctacacgtttttgattatttgtgaaatataatcatctttagacaatagtaaataaaagatatttcttgtttacagatatttcagtgtaagttaattgtgacttggttgtaagcctatgttgaccaaaaggttaaaccacaggcaggagaacttaaagaaatgtaatgtgagttttgttttgagccaagcttgagaactactagcccagtaaagagactccacacaaactgagaatgcgtcccagagtgggccacacgagacacagcatttatacatttctgttatatagaaaatgggaaaagggggcagtgaagcaacggtgactttcttaattcagattggtgctcaatgacattgaatataagataaagtaaatatgtggttaatgtattttcctcattagccttttaccctaatgagtacataggggtcgcagttgcagggtcaggagagggatggttgattttgtgctgcctttgtgcttcatccaataggcaggttgtaatcggtgcctgtcagtgtgatatttgacagactctggccttgcaggtgaggttcagctttcgttcataggcccggtttctattacccatatggccaagatgcagccattttagacaatttttttttcttcagactttccttattttctgacacctatcaagaaagtaaatttgaccaggcacggtggctcacgcctgtaatcccaacactttgggaggctgaggtgggtggatcacctgaggtcagaagtttaggaccagcctggccaacatggtggaaccccatctctattaaaaatacaaaaattagccaggcatggtggtgcacgcctgtgatcccagctactagggaggctggggcaggagaatcgcttgaacctgagagatggattttgcagtgagctgaggttgtgccagtgcactccagcctgggcaacagagtgagactccatctcaaaaaaaaaaaaaagaaagaaaaaaacaggaagtaaacttcatgacaaggatgagcttgtcttcaagaagattaaaactggtactttgggtagcattttctgtggtttaaggaccttagttatatatgaaggaagaatatgatttgccatacttaagtctctttttgtctcccctatcaactatttgcattgaattttttttttttttttttttgagacggagtcttgctctttcgtccaggctggagtgcagtggcgcatctcggctcactgcaagctccgcctcccgggttcacgccattctgcctcagcctccctagtagctgggactacaggcacccaccaccatgcccgactaattttttgtatttctttagtagagacggggtttcactttgttagccaggatggtctcgatctcctgatctcatgatccgcccaccttggcctctcaaagtgcttggattacaggtgtgagccaccgtgcccggcctgcactgaatttttatgtagttttcagtgagtccaggatgttccacaaaagccttttcctttgatcacttcagtgttgccttatctcttctgaaattctttatgccttccagtgttcttttatgtcaagttcaatggttttgcactttacttatctcttcctaactaaaaatccccttgctctcttctttcttcattcatcacattttaaaatcatgattagcaatgtccttccttagtttcccaaatctgccttcctaacttgatttaggcattgcctcaaagcacacttcctcgtgtcatatggtatgatttgtatctgtactatactataatagagctttagttttttctcaagcacttgttgataagtcacttgctgcaaaaatgccatgaattccaggaaagtcacaaacctcagtttcctagtccccaaatccctgcctccctgataaggaagagatgagaaatgggctgaagtgcttgcagacttgtattgaacactgagttggtataaaacactgggactgtccatgaaaatatagtgtatagtcctttcagatgaacagacaaacagatgtgtgctagctgttatataagttaggaagaaagtcaaggaagggtcaagtagagagataaatattatgcttattcaacaaagcaactgacacttaactgaagaggacagagaccgtgggtgacatctgcgtgggggccctgcttgaaggatggggaggatttgcacctacagacatcgagggcagcgtggcatggaagtttgaaagtttgcagcgaccttaaggaacagcagggaaaggaggagatgcatatgagtagagggatagaatggggtatctgctgagtgtcatttgcttcatgcaaggagtgctggtttgggttgggagaggacctgatccagcaggtgttttgttttagcaagacaacgctggataatgtcttctagttgaaatataagaggagtgaggcagagagagagactcatgatcgtctggtggcagagataaggatctgagggagggaggcatgggggttgacagacacaagtagacagatacaggtgatatggtggcgtgaagtgtcctgtccacaagtcccgggtggtggtgtttgttgcttctcccttttggtgctaccttcactatcctgtcctctcttccttgatcacatttagctgaagccctaagaggatggtttgggcttgttctgtatatggccatgctggtcagacacacttttttattgttgtggatgtcatgtactcttcttttggtagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggtggactttttttcttgtatacttgaatgcatttgtctctcgtatgttgtttcaaacacacccaaccccttaagttttttgaccacagaaaataaatggcccatttgtagacagatttgaaaacatagacaagcaggctgtgtccccacagtgcaggaagcctctgcagggcctttcctcccggcccttctccaagacatgtgcgcactgtggtgtgcctgctcctgtctctgtggttactgtcacgtcatggcatctttgctttctaacttgttctcttctgtgcagtgttcctgttacccttggtcctcctttggtccccaagtgcacttgaatttaaatgtcagttttaaggagattttagtttagcatccttttacttttagatgatattggcaaggattacagagtagagtgaaatttctactctttctaaaacactagctttcaagtcctggacggtctgccgtctcttgcaggaggcctgtgggtagttctgctggccacacctgggcatccagctttgtggttgccttcagtctctatatgcctcttttctttctctaacttttcttatacgctgtgtgtccagctgcttaggtctaagatctcccagggcctgtgtgaagagcgttgcatttgcatttgctgctgaggctccttggagctacagtgatacaagcatttcatttgtacctgtgttcctgtgtgaaattctcttcctagtggctgtgtgtggaccccagtcctatcccagtcctggtccacacttgactctgactggttgctgtactgccctctccctgagtgtaagccccttgcggactaggcccagtttgttttgctcaccatcatatctgtagtactggcatattaccttgcacacagtaggcactatgttataaactttgtatttctttaaagaagcatttttttaatagtttgagtactctgaaatcgggatgtacctcataatcaatggtatcttacctgaaatgtgccatttgttgaatgaataaatactgcattttagaattatttcagagattcttcttcaattgcctatacagtgtaagccttttacaatttgagggtctgattttcctgattagatttcccccttggggcttatgtattagttaaatgctacgaattcatggtccactcccaatgattggcacttgtattggttatctttgacacttagaagttcttcctagttcatgagcaaccagtgtgcatcaggattatagccgtcctatcacttgataggagagagggacccatggtcttaatgcttggaaaagttatctttggctacggatgattgtacaagactgtctcttggagcagccaatcaagaattgacctcagtgttttgttacttgggcacagatgtgattcactgtgccctgagtcatgcaaatgtggcagttactgaattaacgagaagcttggcaggctccatgataggatttgtatttccaggtgttacttattttttccccctattattttcattttcaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaaggtaagcaaaaagcagtagtggttcaagtctctggatgagataaaagactctcatctcatggttgtcattctgtcatgtgagtttctgaaggaatcttaaccttcaatgtagtgtgttaatgattctgtgcagtcatttagatatttgggaatcttaatcaggaactcttacctcaagtagcagtgttaggataggggattagaatttcacccccctcttctgggatttacagaccttgttgttccttctagcaaaactttgccccttggccagttgtgggatgtaaacagcaggaaagggaagttaggctggagctgtacagttaagtatttctaacattcagtttaagaaaaagtgttgtagatgaacctttcatactgatcaggtgtcagcaaactatttctataaaggaccatataatgactattttagcttttgcagcctatttgggctctgtcataactgcctagctctgccattggcagcatgaaaacagccctaggaaacatgaagatggatgggcatgactgtgttccagtaagttttattaataaaaataggtgatggtcagctgggcatggtggctcacacctgtaatcccagcactttaggaggccaaggtgggtggatcacaaggtcaagagatcgagaccatcctggccaacataatgaaaccctgtttctactaaaaatacaagaaatagcttggcgtgatgacgcttgcctgtaatcccagctacttgggaggctgaggcaggagaattgcttgaaccaggaagtcagaggttgtagtgagccgagatcgcaccactgcactccagtgtggcaacagaacgagactccatctcaaaaaaaaaaaaaaaaaaatagatgatggtcattctgtgaggttagtatgaccctgatattaaaactagacagcgacatcaccagaaagctagatatcctttatgaatgtagaggccaaaatcctcaacaaaaatactactaaacccaattcagcaaaatataaaaaggattgcacattatgagaagtgagatttacccctggaatgcaaggttggttcaacatctaaaattagttgatataatgcactgtatcaataaaatacagaattaaaaggcgcatgatcatctcaacagatgcagaaaaagcttttaataaaatccaaaccttttcatggtaaagcactcaattaggcataggaggaagcttaatgaacttgataaaggacatctatgaaatccctcagctgacatcatacttaatggtgaaagactgcatgcttttcaaccctaacatcatgaacaacacaacaatgtccactcttggtaattctaatcaaccttgtactggggattctaagcaagccatgtaggtgagaaaatgaaataaaaggcattcagattggaaaggaaaaagtgaaatgaagcaatctgtatttgcagatggcatgatcttttatatagaaagtcttaaggaatctgcaaaaaacatccattggaaataaagtcattaagattgaaggatgtaagatcaatatgtgaaaaccaattgtagttctgtaagctagtaatgaacatttactaacttacaaaagttactactagtaactttcttttttttttttttttgcaatggagtttcactcttgtcccccaggctggattgaaatggcacaatcttggctcactgcaacctttgcctcccgggttcaagcgattctcctgcctcagcctcctgagtagctgggattataggcacccaccaccatgcccagctattttttgtatttttagtagagacagggtttcaccgtgttggccacgctgaccttgaactcttgacctcaggtgatccacctgccttagcctcccgaagtgctgggattacaggcatgagccactgcacccaacctactagtagtaactttcataagcaattaccagcttatgaatgaaattaagaaatcagtttcttttatagtaataccaagaagggtaaaatacttaggagtaaatttagcaaaagaagtacaagacttgtaaactaaaatctacaaaacattgaaagaaattaaagacctaaaattgatggaaagacatcttgtgtttatggaccagaaaccttaatattggtaaggtggcaatacttccttcccaaattgatttattgtaatctctatcaaaattccagcttgctttttgcagaaatggacaagctgatcctaaaatttttatggaactgtaagagaccaagaatagccaacagtcttgaaaaggaagaacaaagttagaagactcacacttcctgatttcaaaacttactttaagacaggatggtattggcataaggttaaaatatatagatcagtgaagtagaattgagagtctagaaataaaccctcacatttacagtcagttgcttaaggtgctaagatatttcagtggggacagaatagtcttcagcagatgtgccaggatgctgattatctacatgcaaagggatgaagttggacccattaataaataaactcagatccaatgtaagatccaaatgtaagaactaaaactgtacaactcctagaatctagagagtatgtgagtaaattatcatgaccttggattaggcaaagccttcttagataagacaccaaaagcacaagtgacaaaaatagctaaattggactttatttaaatgaaaaacattgtgcttcaaagggcaccatctggaaagtcaaacgaccacccacaaaatgggagaaaagatttacagatcatgtatttgataaaggactcagatccagaatatgtaaaagacttataagtcaataataaaaagacaaatagcccagttgaaagaagggataggccaggcgtcgtggctcatgcctgtaatcccagcactttgggagaccaggacgggaggattgctttaggctgggagttcaagaccagcctgggcaacatagcaagatcctgtctctacaaaaaattttaaaaattagccaggcctggttgcgtgctcctatagttctatctccttgggaagttgaggcagaagagtcctttgagcccaggagttcaaggctgtagtgggctgtgatcacaccattgcactcaggctgagtgacagaacgagaccctgtctgaaaaaaaataggtaagacagacatctgaatagagattttactgaagaagatagacaaatggccaaaaaggatatagaaagatgctcagcatcagggaagccaaaaccacagtgacataccacttcatacccgggaagaggaccataataaaaaaaaaaaaaaaaagggaagtaacgagtgttggtaaggatgtggataaatggaaattctcattccttgctgctgcaagtgtggaacagtacaaccactttggagaacagtttgctgttcttcaaattcttataacataaagctaccacacaatccggaattttattcctgggtacatatccaagagaaataaaaacatgttcacacaaaacttgaatatgattgctcccagcagcattattcataatagccaaaagatggaaacaatggctaaacataatatagtatatccatacaatggaatattatttggtaataaaaaaggcaaagtactgatacatgctgccacatggatgaaccttgaaaacattctaaataaaataagccagtcatgaaagaccacatattatgtgattccatttatatgaaatgtccagaataggcatatcaatggagacagaaagtagattagtagttactgggggctgggagtagcagtgagcaggaatggataattactgctaatggtttggggtttcttttgggggtgatgagaatattctaaacttagattgtggtagtggatacacagatctgaatataccaaaaaatcattacattttatacgtaaatgggtagattttatggtatatgaatttgatctcaatggtgatgttatgcaaaccaggttggcaggtcatagattgccaatcctttttatagatctaaccaaagaaatagtctatgtttatttctacaaaaaatgttatatgaatttttttgttataccaatactataagcttatttataaatgagagctgcacacagtgaatatgattaatttgatatattttctcccagtctcttactgtgtatggttttgtaatatttttccacagttgtgaaatatttaacattacttgctgtgttaaactcatttttatatgtaacaataataattattgttaatgtgatttattttgttagaagtaagtttttcattagtttttttggtttttttgttttgttttgttttgttttgagatggagtcctactgtgttgcccaggctggagtgcagtggcatgatctcggcccactgcagcctctgcctcccaggttcaaggattctcccacctcagcctcccaagtagctggaaccacaggcacacgccaccacacccggctgatctttgtatttttagtagaggtggggtttcaccacattggccaggctggtctcgaactcctggcctctggtaatccacccgccttggcctcccaaagtgctgggattacaggcatgagccaccatgcctggcctttttgttaagttttaatctgtggctgtgataaggaaatagggatgaattttagaatgtcaggtctggagcattatattatcaaaccaataatgttgatggtaacttttaaatgttagatatctagtaaacaaaaaagggactcactcggggtctgaaagtagggcagaagtgatggacagccataggaaggcttgtggtcgcacctgtgccaggtctttggcctgcagtgcttacaggtgagggacacatacttgaccactctgtgtagtttgtgcttgagtcagctgctgtctcttcttccctttggaaatgagatgaagagaattcattcagttgtatgttttttaccttcaaaatgtttctcattatggaactaatggattgcttttctaataaaaaatttagatactatacgaagtttatataatatatataacctggaaagattatctctaaagcttgtgcatatatatatatatgtgtgtgtgtgtatatatatatatatatatatatatatatatatatatacacatatatatatatatatatacacacacatatatatatatatgtaaactttgtatttataaatatattttctggtatttttggaagcgccatagcattccattttgtcaatgtttcattcccctactgagtggcttttaggctgtggccagccttttgctaatataatacagctgcaggggacatctttgttgtgtccatctttacatatgtaacttccttgagataagttcttacagctctaatcacacatgaccttccctcctgttcccagggctgcgatcctgatgcccaccccaagagcacaggtgtcttccaggatgaagagctgcttttcagccacaagctccaaaaggacaatgacccagatgttgacctttttgctggcaccaaaaaaaccaaggtcagttccaaatggttccccacagtatgacttgttattgtattgggtgctgtctcaacagctcacctagttctctttgtaaattgttttgcttttggatattgaacttgggtcttgtttattctagctgttagagccaagtgttgggagcctgtttggggatgatgaagatgatgatcttttcagctctgccaagtcccagcctttggtaccagccttttgttctcaatactgggttgtgtgggaaagattctgggaaaggaaactaacgtccagttagatgattaaggaaaatcctaggagagtcgtgctgcttcctgctaaatgaatggcaaataacatgccgaggggagcgtgtgtggaggatgcaatgcttagtttctgttgttcctcatcttatgttccctatactaacattaaaacattaataatccaggctctctgactgtactacacatctgtgtgatgtttaaatggttgattgaaagaccattgcatacactggggtggctaaatattcgtgcctttcaggtgcaaagctttgaatctgagttttagcctttctatgtcattttctcccccagccccagtaggtttttgtaagtactctgttttctttttatcatagagaggactcctgtgacagccacagtcttcagaatgctatttctgaaatgctacctttgagttggttcagccctcatttgagaaagtatttttaagactcagaagccaggattgttttttgcattatgatttttccttaaaacttctaagatatttgatgcctttttggtattttttttcttttgaaggtacaagagaaaaagagagtagtgaaaaaagaccactctgttaactctttcaaaaaccagaaacatcctgaatccattcaaggtagtaaagaaaaaggcatatggaagccggaaacacctcaggttagaaatcctctttaaggattttcagctcttgtttgcatcccagtacagagaaattccattatgcagacccacagttatttagacttgtctgcattaaggaggaaacagcaaccagggctacagctttgtcttcactgcacttcccccgagtcatctcccctctcctcactccacacgccagagtttcatgaatctatactttaatagttagtgttttttgatgccatgccagatttgactctgaagtggagttaaggtaggatgaagaatcttcttcccactaaagaatttatttctccctctggatttccttggaatagaattaaaatagaaataaatataaattacatctgatttcctgcctgctctcagtgttgcctctcccgaggtcattgctgttgggccgtactctgcagcagtcttctcagaacgctgtggagctcctcctgggaacagcccaggactggagagcgagtgacagttccacgtgcaggtgtcccagggtgtctcactgaagccttagtgtcctgagccgtaaacctgaggcacttggacgaacacatcaccactgacccttcctggggctcagatcttttgcttttagagccagtgcattaggctatggttgaatttttgtgtgctccttgaaatttctatttgataaccaacatggtaattttgcctgctggtcagttttaggtgctctgataaactgtgactcttgggaatcttactcatcttgtattccttgactccatatctgatctggcagctttccacttatgtgacagaggaggaggcatacgtgaagtagtgctagtgaaacatcaggccccaggagagatttgaatgcctttcccattaaagagctacagaaagtgacagttttgctccatcacagatttatttacaggcataagaaacacttgtctttctgtttcccaaatggatttttaactggatgtaatcttacacaggactcatcaggtctcgctccatttaaaaccaaagaaccatccactcggatcgggaagatacaagtaattaaaacactggaatcttcattgcctgccctgtggcatctataaacttttttgggtttcctactcttgtcagctgctgccaaacatcttctcatctcttcccccgcctcccctcccctgcacctagttgttgtctcctgtgtgctgcgtctttaacatctattctttgagcccagtggtgggcataggtgtaagacgctctgttttaattctgagactagattgggcgattttcctacgtttctctactcctctcgtattatacattatgtgtaccgaatcttgtcatgtgtcacaataaagataatagactgctgtgttgaagaacaaatacagagtttcatttttcttctttaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaaggtgatgaaaccatctttgcttccttgctctcttcttttaaccagaacatgcatatgcttctttctagtttatcagttgcatacacagcagtctttgactctccttttgaaggaggtgcctcatccttccttcagccgctcccccctccattctccccacccccctcatcctgcacctgcttttccatggcctgcatttggtacatttgcattctgctcagtagccacagtaacgtctcaccactttggctggtgtctgacacctgcaggtttccagcactgccacctgggggtcttctaaccacagagcagatcatgcccctcctgctggcgcttcctcactactccaaggagagcattcgggctcctgggtttggtatgaaacccctttgcaatcggtgccagcccatgtgtgcagcttcctcactagtcacttcacactttccagcctgactccaggcacaccaggtgccactccctgaacacacatggtctgttctgctgctgcccaaggctcctgctgcctcctcaccaggaatgcccctctctgtccacagctgtgcttccacatccccacttctgtcactgtgccctgcactccctgcaccaagttcccacagcagcgacactgtttcatgggatctcctcaatggactgtgaactctttgaagttttcctttcattgtagttgggtttcttgtttctatccagtctcccttctctagaaagctttaactgatctgcaagtaagtgacaggacacagaatgacctaccctgacaaatagattcatttcaaatgtttgcaaacctgtttccttgtgcaaaacaaaacagccttccttttaacgacaattttcattggctttttttttattaagtttaaattggcaactaaaattgtgacattcccctgaagttgacaacacaatcatactttgcccagagtagattgtagcttctcaaaattctacttgattgtatattttggaaactatcataaactgcatcattgctactaagtgattcatgttttgagattatatgaaaagttctgatttctaagccatatttcttatgtggaatatttaacatttgaattcaatgtttattgacttgaagaaaacagcaccttagattacctctctttattgtgtcatgtttctccccgctcctggagcctgaatttagactagccccctaacaaaggttagtaccagaattccccgattctttcttgttttgaaagatacccacgtttctgttgagggtagagtaggggccaagggaggggttgtgagacacagagagccaacatgcctactttccaggtttccagcaacagatgaaactttttgtgtgaaactgaactgaaactgccctgaaaagattaaaaaatggagaactctaaaggattaagaatgacttagtcttggagtactaggagctattaaactccttccttggaaatcattaagaaataacctcttctatgttcttagataatatcttcattgaagtagaccagataaccttacaatattttgagtcactgattctttgccatggtagctttgaacactttattttatcgtcagatcaatgtatgtttttttgccgttgcagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggtaataggacttaacacgtttttgtgtctgttctaagttaaggaaggtatctgattggcttatttgagccatagattatgtctagcttgttgcgtgcataccccatagccacttgcttagtaattataattaggctcttttattaataagtctaacattgattcagaagtggttttttgttttgttgcatgtagaatgtatttcttggctggccatgatcattgatactgatcttggtttctctagtttttacagtttttttatttttatagaatattgttgtaatcagcttcctgggcatgccactcggtgacatggcatacagctccactggtccagcttgggagtttaacctctggttctggggacattggccctggctggagctgacaatgtagtgcatgcaggcaataagactttcagtggcatttgctcagcagatgtttattgagcacctggggactgcaggcacaaggtgaactcagagaagtgctaggctcctcagagctctctgggaagataatcaaatacaaacagggcaatggataattaagatgttttcaaatagtactaagtgtcatgaagaaagtaacctggggcagagtggtgggtagggctgggaggtgctcctttaggcaggactggtagagaaggtgtcactgcagtggcggcatttgagccggggtgagatgcgcgggccaagctgtgcagagatctggggtagtgcatcccaggcagagtgggcagtctcgaggccgttccacacaccctggccaattgcatttccatagcttgttgacgtgtttgagtttaaaaagaaaaattgatttaacattgttttgtatgtatttttggcttaacaaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatgggtaagtttggttttctacatctgacctagagaattcttacctttccatcacttggtatttttcctgctaccttttcttggcccttttctggaaaatgcaccccagcgggttcacttcagtgtaatcctgagttaggctgaagataggtaagagatggactaattattttagtgaagtaactctttcctatgatagtcatcaaagaatttgaaggcacccagagtttgatgtttaagtataatttaactttgatctcagtgcacctcaccaatcatctgtgacacaccctgatgttatgtaaggaggtttgatcagaaatgacctcacgtgctaaagtaggctgaggggactgccttgggtgtgatgtggttggttgagtcagagctccagatggacagggagtgtccatggttctgtgcgagaagagagcaagtctagacctgggtgtaggctctacctcaggcgttgcatttcactgaggtctttggtgtttgggaacaagcttgtcttccttatatggcacaacttctgctttattagtagacaaggcaaatgcccgagaaccctaaatattggacttttgataaatcctgtgggctgagccacatacacatttcctactccccccgtcaatctagacctttagactaactgggagacagctggtgctgcagagccacacactggctctgtgcctccagcaagccgtatgctctgtctcccctgcttcccaccacatggaatgcagaagggaactcattcattattttaaatacaaaaaaagtaatacatgcttattgtaatagattcatgcaattcagaaaatgtaaaaagtgaataacccctagaggtaatagtaacagtttggtatgtatcctttcagacacagtgatattaatatatgtttgtgtacacatcaatatatacccacctttttaaaaagtaagaatatatttccctattctgctctgtcttttagttacttaatgtcttttcatgtcagtacgcagagatctccttccttgttttcagtgctgtgcacgatttctttatatttagccattagcctgttgacggcaatctcgattgtttctgttttctttattacaaataatgctgtggtctttaccatttgtgtacacctaactttatgtatacatgctaaaatcatggttggataaaaccctagcagtaacattactgggtaattaccataattagataagacaagcttttgagtcagtgaaacactaaacgaatgcagtgacggaggcttacagtcttacatcgagatgcctcaaatcagtgcatttattctgaaagaaaacaggtgggtcctatattggatttccctttgcatatttttattgctcttttaaaacccagtatgaaaagaatatctaaataagtccattgtccctgatggtaggggcgtgggctggtttggagatcaagttacccttcccttttttctgtcctgcacacgcacatacatacacttttgtagctgaagaaattgtgctccaagagaaacctgtgtgtgatcataaaatttaatgagtaacaaacacagaaccagaatctaagaggcttgagttctaggttagtgttttagggtactccatgctgttacgagagctgggtctttggtggtttgcttgcatgtgtcttaaaagtacctttctccacccctcttcagcaactgtttttcttttttctttctaaagatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatcacattcatttgtttacttactgtctattgctgctctcaccctacctccaatgtaagagttgagtgattatgacagagactggatggctcacagagcctcagatgttttctatctgcccctttatatacagtttgctgaccattgctctaaggcatccttttccatccttgtcttgtggaagcagcagaatgaacctaggtaatagccgggggaagtgctgaagatggaaatgtcagcctctagagcagcactgccccatagaactccacaggaatgaaaatgttctttatctgtatcgacaaaggcagtagccactagccacctggatggctgaccccattctaatctgtgttttttggtgctctgtcgtcttgctgctgactatgcagcctgtcaccacagcacagtcttgtaggccgcccaggttggtctcagcgatcgtggagctacttacttcttccttgggcactgtaagatcggaaggggaattactcatacccagagtcaaacattttgtacggcttccacaggtcaaccatttgcccaagtctgctgtgagagtgacgtgataacagataagggcacttgctagttggccactcctttcccctattcattttatgcatcttccttctgtccttaggttgagatctccgagtcgctgttgtcaggcagactgctgtcctccagattcaggcctgtgggtctggggagccctggttggtcttggaggagcaagggctgcgcaggtgacttggtggcctcaagtgtataggtacctggatggtgcgaggagatgctggctctgaaatatttcctaatcccgcttgcggatcaactgccgactagcgtttaggttacagacatattagatggttgatgtgattctgtagctcgtatttagaactttagggatgttttcacatatcagtaaatgaagatctatgtcaacattttttttttttttttgagacggagtctcgctctgtcacccaggctggagtgcggtggcgtgatcccggctcactgcaaccaccgcctcctgggttcatgccattctcctgcctcagcctcccgagtagctgggactacaggcgcccaccagcacgcccggctaattttttgtatttttagtagagacaggttttcaccatgttagccaggatggtcttgatctcctgatcttgtgatctgcccgccttggcctcccaaggtgctgggattacaggcgtgagccactgcgcccagcctatgtcaacatttctaatggtagcttcacattctggatatctttatgttggggaaaaagttttaaaggtaactgctcttctgtagcaaagcttttttagagcagaggatggagcaaattctgagttactgaaattacgtattcagtgctattgccttgtttaccttccatttcatctttggagttgtgtttttagaactttttcagaagggatgagataaatgctttgggaatttatttagaaatctttttggtgtcattactcttaagagctagatatattttttaattgtaaaaaattatggaaatacttttttctctacctgctcccatttttttttttttttttaaagacagggtctggttgtgttgcctaggctggggtgcagtggcataatcatagcttgctgcacctttgaactccagggctccagtgatcctcccaccttagcctcctgaatggctgggactacaggtgtgtgccatcatgcccagctaatttttaaaaaaaaatttttgtagagacaagggtctgttgcccaggctggtctcaaccttcttacctcaagtgattctcccaccttggcctcctgaattgctggaattacaggcatgagccacaatggccagcttctttctgttttctttgtttcctcttccccttctgttttcttcctttttttttttttaagctgttctcgcatcattttccatcccatctttaagtcttcattgccacctcattttccaagatcatgagtcccacagtatgctcagctaagcatgaccacacaccatttcaagaagccgttcatggacccagcttttattactggctgggtctttgttctcctgctgcagcttccatttgctcctcagctaccctctaggcatccagtctggcttaaccagatttcatggcctcattttgtcctctgctacagtgatttctactcctgaggagaagcataactatcttctagagggaaacattttagcttttggttatcaaccttggttcttttgggatattggaaattaccccattgactggacccagacttacggtggaagttccagcacaattaatgctgaacggggttatgctttttcttctggcatatagttgaattatccattctcattataggtgaaggacttccaaatctgtttgttatcttctaccctcccccagcctattattttcagggtctcactatggaagaacactgtggtgaaggaaacaatccatattccttaggcagttatagtcactcatgtctttatttctgtcatgtgcattttgcagtcctgacacctgacttctgttgctagagctgcacctgtgtaggtacgagtactgttggcttcggggatacacacgctggcaactctataggacagtcttatttgatatagcataagtatgtttttaagaattcatgttatccaaaattataaaagcagttgtttgaatgagtgaaagaaagggggttaaggttagagagctccatacaaagtcatatataagcaatgcagctttttaatttagcttttatttaagagcaatgaccctttaccactatcaccagcagtattattagcctggtaccttgtattactcttaatacccatcattttgaaatatggtgcaacgacactcaaatgagctgcactacaagaaacaactttcctttctgtaatgccctccctttaggatcactagaagtctgtacaatgcaatgcagattcccgaattaatgatctttcctattagtgtaattaaaaactcatattatagcagattcctgtatgtgcatgtatgttatgagttggataaacgttggtggacttcatttggagtgaatcagaatgggattcctgtgagaagccaacatccctctaaacaaacttttggagcatgatatggcttggatgttttgtcccctccaaatctcatgttgaaatgtgacccccagtgttggaggtgggcctagtgggaggtgtttggatcatgggggtggatcctcatgaatgtcttggtgctgtccttgtggtaatgaatgagttctcactctgagttcacatgagatctggtttaaaagaacctgggggccgggcaccgtggctcacacctgtaatctcagcactgcgggaggccgaggctggtggatcacgaggtcaggagatggagaccatcctggccaacatctagaaaccccatctctactaaaaatacaaaaattagccaggtgtggtggcacgtatctgtagtcccagctactcgggaggctgaggcaagagaattgcttgaacccaggaggcagaggttgcagtgagctgagatcgtgccactgcattccagcctgggcgacaagaggaagactctgtctcaaaacaaacaaacaaacaaaaaacaacctcacacgtccttcctctctctctctcttgttctctcaccatgtaacatgctggctcctctcctctaccatgattgtaaacttcctgaggccctcactggaagcagataacagcattataccccttgtacagtctacagaaccatgagccaaaataaacctcttttgtttataaattgcccagtgtcaggtattcctttatagcaacacaaacagctaacacaggataaccaaatagttattaatgtctaaaacttggataataccttacctatagcacaggtttattctgaggatcaattgaaagacaaaaatatctgttctttccttgaacaaagctttaatgagtaccaatatgtgcaaaacactgtgctaggtggtagagatcagatgtgctcccttcagtttagtaaaaaatgaaattgttagggaccgggtgcggtggctcatgcctgtaatcccagcactttgggaggctgaggcgggtggatcacgaggtcaggagatcgagaccatcctggctaacacagtgaagccctgtctcttaaaaatataaaaaattagccaggcgtggtggcaggtgcctgtagtcccagctattcaggaggctgaggcaggagaatggcatgaacccaggaggcggagcttgcagtgagtcgagatcatgccactgcactccagtctgggcgacagagtgagactctgtctcaaaaaaataataaaaataaaataaaataaagaaattgttatgggtgcaatatatgatgtaggtagtagtgtaaagggggtaggtataaaagctttgtggaatagttgatattggagctgaatgttgaaaggtgattaggtgcttgtcaggtaaccatgtgtgcacaagacagtaagtagagcagagcaggagcaacaatatagaagctgatgtgttctgaagctgcagatgcagatgattagaggatagaagtaccagagatgttgcaagatgaggtgaggtagtagatgggtaaaatggggccggaatatgaggtgcataatcttgggagcatttctaaggagtctgaattttattctatagacagggagaagtcattatagcgccttgaggcaagaaataacatgatcagctctacgttttgaaaagataactgtgctccacattatgtgtcattagggaaatgcaaattaaaacagcagtgacgtactattacatgactgttacaatggctgaaatccaaaacactgacaacaccaaagctggggaagatggggagcaacaggaactctcattcactgctggtgggaatacaaaatggtactttggaagattgtttggcaacttcttacatattcttactgtatgatccagcaattatgctcctcggaatttgcccaagtgagtagaaaacatgttcacacaaaaacctgcatacagatgtgtacggaagcttttttcataattgccaaaacttggaagcaaccaaaatgtccttcagtagatgaatgtataaataatctctgtactatacccagacaacggactgttattcagcaccaaaaagaaatgagctgtatcaacccatgaaaagacatggaagaaccttaagtgtgtgctactaagtgaaagaagccaatctgaaaaggccgtatactataaaatcccgaaatacgttctggaaaaggtaaaactatggagacggtaaaaagtgtagtgtttgccaagatctgaggggagagaggaatgaataggcaaagcacagaggatttgtagcacagtgtatgtattctgtgtggtactgtaatggtgaatacatgtcattatgcattagttcaaatccatcaagagtgaaccctaatgtaaattacaaacttcaatttatgtgtgaaaatgatgtgtcactgtggggttcatcagttgtaataaatgtaccactctggtgcaggttgtgataggagaaggctgtgggagtgaggggcatataggaacattgtaatttctgctcagttctgctgctcaaaaaaagaaatctattcaaaaaggagccttttcatgtttagactaacttagttcatttccctcctttagttccttcattggtgaggtttcattgcaatgcattctcaagtcgaacataaaattattttagagctttgtgtgacttttccccttgcttaaacatcattgcggaataatgtaaaaatatgataccctaatctagttttcataaacttttttcaaagttgaaaaaaaaactagcatcatggacagatgggttgaaagagtgaacggcaagaatcgaggatcaaaactaggccatgaaaattgctcagttgagagctaatgaagccctaaattaagtcctaatcattgtagatggagtgggtgacagatttaaacaatattaagaggctgggcacagtggctcatgcctgtaaccccagcactttgggaggccaaggcgggcagatcacaaggtcaggagttcaagaccagcctggccaatatggtgaaatcccatctgtactaaaaatacaagaagtagccaggcatggtagtgcatgcctgtaatcccagctgctcaggaggctgaggcaggagaatcgcttgaacctgggaggtggaggttgcagtgagcccagatcgtgccactgcactccaacctgggtgacaaagcgagactgcgtttcaaaaacaaacaaaaaacaatattaagaagtcatattgtctagaattggtcatttctaggtgtcatggggttgggggaaaatccaaaatgattgacagatcattttgagtgatggcatgaaaggcatctctttaccaagatggggactacaggaaagcaggaggtttgtgggaaaaattataagttttgagtacattggatttcagaggcctctggaatatcatgcttatggagtggagattactaacaaaaccaccatctttaaaaataactgcttctttaaacatgcttatattgtagtgagttcagtgatatatcctttggtagaaaaaattgtaaaaaaattatgtatggcacatttctctgacgcttgcactttcatagtgttcactttctgttcacctaggtttacttactgatatccttctcccactctgaggctttgcctatcctgaaatacatctaaacatttacccatgtcagaaacacttcccaactcatcctataaggccaatattaccctgataccaaatccagacagacataaagaaaactacagatcatctcttatgattatagacacagagatcctgaggaaatacttccagaccaaatccatcaacatatgtaaaggttacgtactatgtccaaatgggatttatcccagtaatgcaaggttgatttgacacacaaaaattaatgtaatatatgaataaaagaggaaagaaaatcacatgatgatttcaatagacactgaagaaagcatttgacaaaattcacaccccttcatgattaaaaagaaaccccactaaaataggaatagaagggaagctcctcaacctgataatggttatctataaaaaccccacggttaacgttatacctaatggtttccttctacagtcaggaataagacaaggatgtccagtctcaccacttttattcaatcttatactgaaggttctagagcagggcaattaggcaagaaagggaaataagaagggcatggtggctcacgcctgtaatcccagcacttgggaggccgaggtgggtggatcacctgaggtcaggagttcgacaccagcctggccaacttggtgaaaccccgtctctactaaaaatacaaaaatttgcctggcgtggtggcggatgcctgtaatcccagccacttgggaggctgaggcaggagaatcgcttaaacccagcaggtggaggttacagtgagccaagattgcaccattgcactccagcctggacaatggcgcgagactctctcaaaaaaaaagtgggggagggaataaaagggcatatagattagaaagggagaagtaaaactctatttgtaaatgacatgatcttgtatataaagcttttatatagaagatctttgggaagaactaaataactaaatgaactaaataaacagttcagcacagttgcagtgtacaagatcaatatattaaaatcagttgtgtttctatacgctagcaatgagcaatctgaaattaagacagtgattccatttataatagcatttaaaggaataaaatacttaggaataaatttaacaaaagagaacaaaacttgtactctaaaaattgtgaaacattgtggaggtaaattagatataaactgaaaaatagtacgtatttatggattagaagtcttagtattaagattgcaatactctccaaatctacagacttaatacaatccctgtcaaaatcccagctaacatttttgcaaaatgggcatacttaaaattcgtatggcaattcaaggagtccagaatagccaacaatctaaaaagagaagaacaaattggaggactcacacttcctaatttcagaacttactacaaagctgcagtaattaagatagggtggtactggcataggtagatcgctagcataaagagtctggaaataaaccttcacatttacaaaaaatggatttttaacaaggatccaagacaattcaattgggaaagaatgatttttctgacaaatgatactggaacaactgtttatccacatgcaaaagaataaagttagaccctacctctcaccatacacaaaactaaattgaaattggacaatacacctaaatataagagctaaaactatacaattcttagaaaaatatataagtcaatctttactacttgggataggccaagcttttgaagtatgacaaaagaaaaatagccaaattagactttaccaaaatgaaaaacttgtgtgtctcaatagatgccatcaagaaagttaaaagacaacccacgaactgagagaaaatatttgccatttatatatccgttagtgtttttatctagaatatgtaataaaaaaactcatacaactcaataaaaaatccaattaaaaatagacaaaatatgtgaataggcatttctccaaagaatgtatgcaaatggccaataatcacattaaaatgatgctcagtaccattagtttttaaagaaatggaaatcacaaccacaatgagatactacttcacacccactaggatagctttaatcaaaaagacagaaagaagtattggcaagggtgtggagaaattggcaccctcattcattgttgatgggactataaaatgatccataccatttagaaaaatttggtagtgccacaatttgctaaacataagagttaccacataacctagcaaagctacttcagagagaaaggaaaacatatgtttacacaaaaacttgcagttgaatgttcatcttagcattatatgtaacagcccaaaattggaaatgactcaaatgctcatcaactgatggatggataaacaacatgagatatattgctacaggggactattattcagcaataaaaaggaatgaagtactgatatatcctagaacatgatgaactttgaaaacattatgctaagtgaaagaagccagtcacaaaaaaatcatatatgatcctatttatgtgaaatgtccagaatagaccaatttggagatagaaagtagattagtggttgccctagggttgagtgggggactgggggaatttgggagtgttggttacagggtatggggttccttttagaggtaatgaaaattttctaaagcaaatgtggtgattgttgcacaactctgtgtacatcataaaaaccagtgaattttaggctttaaatgagtgacttttatggcatgtgaattatatttcaataaagctttttttcttctttttttgagatggagtcttgctctgtcacccaggttggagtgtagtggcgtgatgttggctcactgcaacctctgccttcttgactcaagcgattctcctgcctcagcctcccgagtagctgggattacaggcatgcattaccatgcccaaataatttttgtatttttttggtagagaccaggttttgccatgttggccaggctagtctctaactcctgacctcaggtgattcgactacttcagcttcccaaagtgctgggattacagatgtgagccacttcacctggccctcaataaagctatttttgaaaaggtttaaccacctcaccagaaagacgtgtatcatttgtcctagtttaagttcaaggcccccatttacaaatttttcactgattaatagtcttttcatgtcactacatagagatctccttccttgttttcagtgatgtgcacctctgggtctttgcactggctcctgccactttttcgaacactgttctcagaatccagcttgtttcctcactcttcgatttctctgtgaggcctccctgatgaaatacacacaacaggaagcctgctaacacataccaccctgtgctcctggtcccctttcctgtttcactgtttaccacggcacgtgttgccagggacaatgtatatttacttattcattgtctctacttcccactaaagtaagtgccacataggcaggacttttcgttccctgtttgtatccctaacaccctgtccttaataccagtgcttggcatgtggtaagccacaggctcttgtggctatacaacatttgctctgttctcaagtggggtgattctgtcgatgtctggagaaactttgggttgctatgccttgaggattaactaggtgctactgacatccagtagctggaggccagggaggcttctgaacactgtagaatacacaagaccaccctcaacacaaagaatgattcagccccaaatgtcaacagtgctgaggctgagaaaacctgtgttagaccagcactatccaatagaaatacaaccaaccggtcgggcccggggtctcacatctgtaatcccagaactttgggatgccgaggagggtggattgcttgagcccaggagtttgagtccagccttggtaacacaacaagacattcaacaagaaattaaaagattagctgggcatggttacacatgcctgtggtcccagctacccaggatgctgaggtggaagaaccaattcagcccaagaggtcaaggctgtggtaagccatgattgcaccactgcattccagcctgggcactgaggccacacttcctataggctgctcccagccagaaccgagcatgccagggtactagtgccacttgttcctgcaggacaagggaatcctctaacagtcaacagtccaccagagactcccaactgatccggccaaacgttcctagagctgtgctgtgtctcggactcctcctgccctaccttccttcctttcccctctcccctctcacacggcagtctgaaggctctccctgatcactcctggcccctctcttaacctgcacaggtgcatccccaataaatctctgctgatttcattctaacttggtgtctgcttctgggaggattcatactaacacaggtttcaaggtcagacagcattcaaatcccacttccatcacagaacctgagccagttcctacccctttctcagcctcagtttcctcagcagtgaaaagaatattgaaacagaaactctttgaaagctcttcctgtcctgatctgttccagaatcgggctcagcagggttcatgcaaggacacaagtgtagctgcctctgaggagcccctcacatgcccattttagccagtttgtttctccctgggctcctacagcacatgtgcccatcacacagggttgcaaacaccagttttcttctctgattccccaaagggtgctggacacctgtagaggggctctgttttggtcacttgtccatgatgctcagagaatgtttacagtgcacagtgaatgccgagcactggaaatgctcagtgaagcaagccaacaccagccccaccagatgtcagcaaggaggagttctgtggctatagtctctttggttccatggaaatgacaccaacaacccacataattgagggccctgtgcaggtgccgggttcccagcaaaagtctttgcatgtattttctgttatatgaatcctcctggcatgctcattgagaggttccattactacatgcccatcttcataaactaaacatgaataaactgaggctcagggaactggagttgatggtcccagcctgcacagctaggaagaatcaaggggtgagttttgggttttattttgcatatttcagcagctttactgaggtataatttacacaccataaaatttactcacaataaatgtacagttagatcagcaaatctatagatttgggcaaccatcagcacaagccagttttagaacatttctattaccctgaaaacatttctcttgcctgtttgcaggcaatcttccattcccacccccagccctaggcaaccaccaatctgctttctgactctacagatgtgcctttttctgcacattccctcttagtgaaatcatatactgtgtggcctttatggttggcttctttcacatagtgtaatgcttctgaggttcatccacgttgtaatgtccattgtggcttcatccctgtctattgacaaataaagttctgtttcatgggtggatcacaaacgtctacatatccattcttcagctggtgcacatttgggttgtttccagtcttgagccattatgaataatgttgttatgaaaatgtgtgtataagtttttgtgtgagaatatgttttcatttctcttgggtagatccctaggattggatttgctgggtcacatgatgagagtaagttatacaagaaactgccaaacttgtctatgtaaattggttgcccaccagcagcatatgagggttccactgctccacacagtagggctgagattggaggcaagtccagcccgaccccagaaccccattacccagctctttggtgatcctttctaacattgggatacccagctaaggaatgaggatcatagctgtgcaggaatgagggctgtctgtgaaaacaagaagtgctcctgcaccagcccagacaaagacccctcacttatctcatttatttcttgtcctccaagtgatgctggagcccctgggtttccccacatgcaatccctcaaatttctgacccctgctatttatcttccattgagccttaggttccggtgagagtaacaaggatagacaagggttcacagcccagggctagggatgccctataccctggtcagtgaccttggaagggctgattcagctggaactcaatattgaagcacctaggatgtgcctgtttacacacagaaaaaagataatgcagaagcatggggtccctgattagctgatctgagctggggtggggcttggcaatcattggatccagtgcttttcctgaaacatgagcattgagtttcctgcccacacaaccctgggcttaattaagtccaagcaacaaacagggtcctcagtatgcttaaaggattgacattggatggaagacaattcaatgtttgagaaatccctgcagaccctctgggagtgtcttgaattctaaggagaccatcttgccctacttccttatttgacagaaatggaaaactgtggctcactgaggtggagtgaaataccccaggtcatccagcaaggtgagggtggagcaaaggcttggtcccatggcatatattcatccatctccttgcccatccgttgtcttccagcagaatgtaagctctgagaagataaggattttcctctccttttctacaactgctgtcttccttgattctagcacagtggctggcacaggttgggtgctcagtaaatatctggtgaatgggccaggcacagtggctcacgcctgtaatcccagcactttgggaggccaaggcaggtggatcacctgaggtcagaagttcgagaccagcctggccaacatggtaaaatcccatgtctactaaaaatacaaaaagtagccaggcatggtggtgggcacctgcaatcccagctacttggaaagcagaggcaggagaatcgcttgaacctgccaggcagagattgcagtgaaccgagattgtaccactgcactccagcctgggagacagagcaagagtctgtctcaaagaaagaaagagagagagagagagaaagaaaaaaaagaaagaaagaagaaaatgaagaagaaagaaatgattctaagttattgtttttaactgctgcagagtattctgtggtaggaacatacaatagttcatgtagttattctcccaatgatgaacctttagatcattgccaatatctcactgctaccagcaatgctgctaagataatcttgactatactttcttgcacacacatgcaaatgttttggttttaacagatatgtcagatgccctccaaattgactgtactaatatgcactccctttggtgggacatgagggtacccgtttgtccaactctggctaacatttgttatcaaagttaaaaatacttgccaatctaatcagtaaaaatagcatctcaatgaccttttatttgtatttccttgataaatggtgagatcgagcattttttctttcttagcaattttaatttccttgaatagtattttcatatgaattgcctatttgctattcatttgatttttttcttattgcccatttattatgaacactcatttgtttggactttattatctttgtgtctttttttttttttttttttttttgagatagagcctcaccctgtcgctcacgctgaagtacaatggcatgatcttggctcactgcaacctccgactcccaagttcaagtgattctcctgcctcagcctccaaagtagctgggattacaggtgcccaccacgaagcccggctaatttttatacttttagtagagacagagtttcaccatgttggccaggctggtcttgaactcctgacatcaagtgatccaccctcctcagcctcccaaagtgctgggattacaggcatgagccaccatgcctggcctatctttgtgttttttattgatgatgctctgtttctctttttgtccccattcttgttttctgttgggttgattgaaatttctttgttccatcttatttccactactggtttgaaatttatacatttcattgctatttttctaatggttactcttaattttttatatccatatataatgttgcctaacaaaatctgaaggtaaactgtacatatagactcttcccaaacaagataagaaatgttcacttcctccccctgttttcctttttcccaagtctcctgttgatataatccagaattctaattccaaattgttattttaagcatccatggcaatcaatactttagtcttaaataatagcattggctgattacttagggaagtgttacttttttcgcactccttcttcctctggtttcatgtcatttcttgcaggagggcttcttaagtagttgttttcaacagaatctgttggtggtaaactttcttaaatcttgaatgttcaaaaatgcctttgggccgggtgcggtggctcacgcctataattccagcactttggtaggccaaggtagtcagatcacttgagcccagaagttcaaaaccagcctgggcaacatggaaaaaccccgtctctacgcaaaaacaaaatacattagccaggcgtggtggtaggttcttgtagtcccagctacttggggggctgagatggaaggatcgcttgagccaggaaggtcaaggctgcagtgagccttgatcatgccactgcactccagcctgggcaacagagcaataccctgtctcaaaaaagaaaaaaatggctttgtttcactgtgcccttaagtgattctgtagctgggttatagaattcagcatcaattagttattttccaaagctcattgaagacatggcttcattggcctgtatctagtgttgctaatgaaattaatgaggaaaatctgatccttatttctttgaatttaaactatttttttttttttttttttttttgctttggtagcttttaacatttttttctctattttcatagctttcttcacttttggggaatttttagctattaattaaatactactttctcccattctctctctgcctttggaattcctactagacgaaagcttgaatgcggtcacccagactttctggctcttaaccttttcacctttttctctttgttctttaacctgcaagactccctcaactgaatgctccattttgctaatggacccttcagtgtgtctctgctgttactcagcctatcttttgaggtttttctttcaataacttgggctttaatttttgagatctctaattggttctttttcataattgcttggttttattttcccctgttttgctgaaggtattaaatgtacttgctttaattgacctttggttgtagagaagatttttcatttgctctatttgttatttctctttcatagcagtgggcttcctcagacatctggcacttcttcaatgcacactagatttctggtttccaattctccacctgagtctcaggattctgcagcattcccaggtgggtgcagactcaggttacctgggccttggcttctcccatggcttcttaagaacttccttgtttatttctgtgatcccaagcactcccctttatgacttcaagcccaattgtatagtcagtaatttaatttctctatctgttctatcatttataagggcacagcatggaggggagggcctttcagatatttttcttgccccatcttaaatccctaaattacacttaaaaaaataccaccaaagcttttgtcttttatttaggaagaatagagtactcagacatgagtttggagtaggcgggtgtatgtgtgtatgtgtgcctatgcagtttaaacctgttctgtaatgtattgcaataaatgtttcagtgtcggtacagtgaacaattcaacttcataataggccaatctggaatctcccagaaaaatttactttgggtgttagtgctttttttttttttaatcattaatatctataggaagacctagtaggagtggctgacaaagtttaataaatctcatgataaaatgcttgtttttgatgtgaatgttgttcctcagtccatcctaaaatgaaattcacagggttgggttcgatgtcttcttccacacctctcattacaatctgccataggagtgcagaccgcccccatctgaggcctggatttaatgctcaaacaagacagatgccagcaggaaatatttgccctgccttcgctgtaaatcttgagtccttgtccatgatatcctaaaaggccaccagatggaaatgtgatgccgtgaaaagagatgcactaccctttgcaaagggggattgaccctgctgctctctcaaaagaaattgtccttattcaatgtaaaacaaggttttagaaatttttctttgttgaatgtagaataaagagggcattacatgaatgcctatgcatttcagctttggagaggaatccttacatccattctgacagcatggagataaaaagtctgtctttctgtattcatgttttgttgtcatttgctttcttttctcccttcttggtctgtgtgtaccacatcctctctatgtcttctctttctttcttttttttttttttgagacggagtctcactctgtcaccaggctggagtgctatggcatggtctcggctcactgctacctccgcctcccgggttcaagcaattctcctgcctcagcctcctgagtagctgggactacaggcatgcaccactacacctggctaatttctgtatttttagtggagacggggtttcaccatgttggccaggatggtcttgatctcttgacctcatgatcggcctgcctcagcctcccaaagtgctgggattacagatgtgagccaccgcacccggcctatctcttctcttttttgtcctctcctttgttacctggaaccaacttttcatccctctggcctttgtctcttcctattttctggccatatgtggatcagaaaaataattataaaaatgatttgttgttttacttactacaaatgtatgatttctgttttcattgcaaaagccaatgggtaagaatttttaccattccttcactgtaaaaaataaaactgagggccggtggcggtggcttatgcctgtaatcccagcactttgggtgaataaggtgggcggatcacgagttcaggagactgagaccatcctagctaacacagtgaagccctgtctctactaaaaatacaaaaaaaaaataaaattatcggggcgtggtggcaggtgcctgtagtcccagctactcgagaggctgaggcaggagaacggcgtgaacctaggaggcggagcttgcattgagcagaaattgtgccactgcactccagcctgggtgaaagagtgagactccgtcttaaaaataaaaaataaaataaaaataaaaaataaataaaactgaggccaggtgtgatggctcctgcctgcaatcccagctacttcggaagccaaagcgggaggattgcttaagcccaggaggggttgaggttgcagtgagctatgattgcaccaccgcactccagcctgggtgacagagcaagatccttactcgaaaaacaaacaacaaaacaccaaacaaaaagctcctgcattctgccaaaactaactgaataattttaaaagtattttattgagttataataatccaaccaaaaattgtacctattataactgtatgtctcactgattcacaaataaaaaaccacagtcatttaaccagtactcagattaagaacaagaacattacctgtacgcctgaaacccccatctgtccccatccagtctctaccttcctcttacccaaggacaatcatcacccagacttctaatagcacagaataatttcacttatttttgtgctttataaaaatggcatgaaacgtcctagtttgggttcccctaggagctgccctgagacaagtatttggcgacagttcttttatctggaggcacagggaacactgagtggggcatgaagaagtgagccaggaaaaaggcaggcagcagccataaagaaaaatgtgttaccaggccaggcgcggcggctcatgcctgtgatctcagcactttggaaggccgaggtgggcagatcacttggggtcaggagtttgagaccatcctggccaacatggtgaaaccctgtctctaccaaaaatcaaaaaattagctaggtgtggtggcaggtgcctgtaatcccagttacttgagcagctgaggcaggagaattgcttgagcccaggcggtggagggtgcattgagtcaagatcacaccactgcactaacagcctgggtgacatagagaaagaccctgtctcaaaaataaataaataaataatttttttctttcttttttttggagagacagttctcactatgttgcccaggctggttttgaactcctggactcaagcaatcctcccatctcggttctcaaagtgctgggattacaggtgtgagccaccatgcccagacattttcatcattcattttttttttttttttttgagacggagttttgctcttgttgctgagactgaagtgcaatgtcaccatcccggctcactgcaacatccgcctcccaggttcaagtgactctcctgcctcagcctcctgagtagctgggattacaggcatgagccgccacacccagctaattttgtatttttagagtacaaggggtttctccatgttggtcaggctggtctcacactcccgacctcaggtgatctgcccatctcagcctaacaaagtgctgggattacaggcatgagccactgcgcccagcccattttcatcattcctaatagccatggagcattccatttaatcaactgtatatgcatttttttttccgggggcaaggggctcatattcacacacatgggaggccagttggtgagaaggtggcaggcggcatagccaccttatacagcatgccatactggtccactgtcagaccggtgatggccacagctccatcaccccccatgctgactctggctcctgcctggctctgcccggccaccacaacccctcgggaccattcagaggcatcactggagggtgtgtggttagtggagcagctggtcatggggaggtctcgtttctttggtggaaggcattcctgactcctctcatgaacaggtttcatattgctttgtggtgttcctggagcctggaaggagttggcttgctccctggggcatcaggaggggcttctcggtagcttccctgtacccctcactgcttctggctggggcgcccacatctgagcttccagtggtgcttctgaacagctgtagtaagcgtcctcccggctggctcgggagccagcccgtttcacagcgcttcctgggatccacccgctcatcctgcagccgccgcaactgcagccgccgtcatcccggccctggagcccccacacacccctgtgtatgcaatatttgttaaccattcccttttggtgcccatctaggtacaggtctcatttttcaagctaaagtatctgtaatacactggaagtaatagatgtcacctccatattgtatgccaaacctaataagcagagcaaaacttttcatccaagtgatttggttaacattttaggatgtttctaatctctcagtaatacaaatatgctacaatagatctgtgtgcttatcctttgggcacttgtgtgtacctgtgcatacctggagaataaagtcctgtgagagaaactgccatccaaagagggtgtttcagtctgtactgccaccaacaatgtgctcgtgcctctgagcttgcgtttgggtcaggagaatttgaaagtcatcaggaaccaaaccaggatataaggttcagctgcagctggaaagtggcaaacgttccaaagctaagacattggctattcctgggctgttcacaaactgtgaggccaattctagatgagatccagaaaaagggtgagcagctcacttattttttaagcaaaacaccttttcttctcatttctgctaagaacaaatagcttccagcaagataaataggggatgcaatatttttacaaattatttctttttttattaaaaaaaattttaggttaaatgcgacttaagatatgtttaacctctatgatactgacttgctcatgagaagaaagagagagggccaggcattcttgcccactactacccactatcaacacttaggcctgacatcagtctctaaataaatattctgggccaggtgcggtggctcacgtctgtaatcccagcactttgggaggccaaggcaggcggatcatgaggtcaggagatcaagaccatcctagctaacatggtgaaaccccgtctctactaaaaatacaaaaaattagccaggtgtggtggcgggcgcctgtagttctagctactcaggagactgaggcaggataattgtttgaacccaggaggtggaggttgcagtgagccgagaccatgccactgcactcctgcctgggcaagagagcgagatcccatcttaaaaaaaaaaaaagaaagaaaagaaaagaaaagaaaagaaaaaaaatcaacagaggcttctaggatgactgagcagtgactcagtctctccttgatcagattctgtaaccatccagcagaaaagtttacctgatctgtgggagaacaggaagcagctcagtgggggccttccttgctaaattcttcatcaagctggtctgttatctgccctgagtcctgcaagaacatctcaagaaaaatcccaaaaacatgcaagacaaatgaaggtcctcccttagcgtgttcttgaagcactgaggtgcctgaaaactatatatactttctggggaaacagttttttaggaaatgtagcacagacactaactattcttccaggagagccccttcctgacatgaaagatcttagcatgagagagaagcatctgattcatcatggggacatatccaaccagcagcaggggccccagtgccggtgtccacctcagcagaggagacacaggggacatgaaaagtgtttccattgaaaaaaacttcacctagggtgactatagttagcaggaatgtattgtatatttcaaagtagctagaaggctaagtgtggtatcccatgcctataatatcagcattctgggaggcgcaggcaggcagaacacttgaggtcaggagttcgagaccagcctggctaacatggtgaaaccccgtctctactaaaaatacaaaaaacaaaaaataaaaaattagccgggcgtggtggcctgcgcttgtagtccaagctactcaggaggctgaggcaggagaattgcttgaacctgggaggcagaggttgcagtgagccgagatcaagccactgccctccagcctgggcgacagagcaagactctgtctcaaaacaaaaacaaaaacaaaaaaacaaagtaactggaagaggggacttcaaatgtgtccaacacatagtaataccaaatattcaaggtgatggacaccctaaacaccctgattgatcaccacacattctgtgcatgtaataaatactcaaatgtactccataaatatgtaaactattttatatcaataaggaaatactttgcctagcgtttccatccaaatgggaataaatccagggctctacgtacatatttcatggctttttattgagacttgggaagggtgggccatggtagcaggtgcattcactgtccaagtttgcccagactctctgctgcatgggtgatggcatttgtgactgtgttggtcactgtctcagtgacttccttcatctttttgtcccctgactcttgggctttctttatggcttcggcaatggctgttggaaagaaagaagaagaatgtcctagtgatccacccactgaacttgtatccccttgagtggcctgtgggatgtggccatcttaatggattagtccatggagtggcccaatgggaccaaggggagcaggactcctggcagaatgaatttgaatttggttttaatttccccaacaacttgtatttcttcaactctgagactgagcatctactcatgggtacattgcctgcttatcctttttttctggaaaatgcctgcttatgtcttttggccatttttatgttgggttgttatattgcattatcatttctattacaaatatttttcatagtttgtgatttttcttttggcttggtttatagtattttttttttttttttggctatagaaaattttgaagttttggattgtcaaatttatttaatatttcctttatggctgctgggttttttttccatagttctaaagattctcccctctccaagattaggccaaagtctcttatgttattactatgtctaaatgtttatgatgtcttccccctcaagactcatacgttgaaatcctcagctctaatgtgatggtattcagaggtggggcctttgggaggttgaaattagcacccacataaaagagaccacagagagctagctccttccacaatgtgaggacacaactaggcccatccacgaaccaggaagacgccctcaccagatgccaaatctgctggagccttgatcttggacttcccatcctccaggagtgtgagaaataaatttctgttgtttctaagtcacccagtttatggtttgtttttgtttttgtttttgagacagagtctcgctctgtcacccaggctggagtgcagtggcacaatctcagctcactgcaacctccgcctcccaggttcaagggattctcctgcctcagactcctgagtagctgggattacaggcatgtgccaccacacccagatgatttttgtatttttggtagagacagggtttcaccatattggtcaggctggtctcgaactcctggcctcagctggcccacctgcctcagcctcccaaagggctgggattacaggcatgagccactgtgcctggcctatggtattttataatagcctgagctaagatagttatctcctataagttaataaattcatgtatgtaaatttcagtccttcatctacccagaatctattttgttgaagaggaatgagatatacacatgcttgtacatagttctactcatagctcacacacatcaatttgacatttaacatataattttacatgttaaatgttttgtcccagtgtgctgtcacatagtcttttgtgactttgtcttcttatcattccatggagagaaccatctagacagtgccctaacatagtacagtctgtggcctctgatgaacatagataactgtcccagccgagaggctctgaaaggctgcaacattaggtgcagagtttgacccggttagtcaaagaacaggttggcccagcacctagcttcccttcctccctccctccttccatgcccgacctcagccagctgtacctttctctccagtctccttggcatgtcccaccacctccttcaccacttcctccatggcatgaactgaacagaggagacaagtccagggtgagggctcagagcaggcccgctgcccccgagtccaggatgagggctcagagcaggcccactgcccccacagcccagggtgagggctcagagcaggcccactgccctcctgagtccagggtgagggctcagagcaagcccaatgccctcccagtccagggagagggctcagagcaggctcatgtcccctgagtccagggtgagggctcagtgctgacccatttatcctcacaatggacctatacgtccctggacatccaaggtggggctccgggatgccacccccagccaggacagactggctcattagaaggaacttcccccacagctgccttcatttggagatgccgggacactggctgatgggagacaagctcagtgagccccatgagggcatgggcccctgaagccccttggccctgcccagcctggaatgtcaatgatcagactgtcttgccagctgagacctggagaccaggctaggcctctgtgccagattacatccctctcaggatgtgctggcgcctgcctcaggttaatttccaaagcctcatccagtaaaaccatgtctctcaaagcaattcctccaacaagagggaattctctgcctacttcagagttttttaaagtgtgggtggtagtgtgctagaactgaaagattttggagtcagaagaaatggttcttattctaactctcccttccacctcttggttccctcatctttagaatgggaatctgttgggatgatcagagccaacaccaggtcgtgggggcaacaaagtcccgcggagtcaaaagaatgagaaaaagttcaagagagaaagtgggaccagggggccattgccagtgtggaggctgcaaaggcactgagctctgggagcccatgctatttattggtgatctaacaaagaaacaggtggtgaggatgtggaggttgaaaggaaacagtgtagcaagtgaatgagaaatatatggctacttgagataatgggaatgctggaatcaagaagccagcaagtctagcagacatgcaagccctgcctcagcttctctaccaacactcagcttttctcccaacaggaatcatagaaaactcagaggctagtgaaaggttaaagcaggtggttatcaccagctgcagagtcaaaaacaaaatacacatctgctgccatgtagaaagaggacacaaactcaggcaaggctgtttttcacatgatgacccatgagtggggcctggctgggcctccccacacacagctgctgacctctgcatacaaaacatgcttcggcccagaagcacgccagcattcacccacctgtgggtatcagtcaggctcctggtggaagccagaggacatattcgaatgggtacttgaggaaaaggggctgttcacagaagtgtggacagagttaagggaaccaatgagagatgagaaatgccctggaccagcaagagtgggagctgttatctccctgggtctagagggacaggaaaggtgtccacagaccccgaagagagctgtggctgtaggggaggatcatcaggagctgcagccatcactagaaagatgtggccactggcaaaccagcaaggaagaatctgagtgaataaccacctctcctctctctcccacctcctatgacatcccccactgtctgaattccactagggccagacagtgaggaaccttggtgatgcagtccaagagggagtgggcagagaggagccagtgggtatggaggggaaacagagaaacagagaattccagctcactctgcgggatttctgggtctgatagaaacatagcagcagcttaattattattattttgagatggagtttcactctttttacccaggctgaagtgcagtagcgtgatcttggctcactgcaacctctgcctcctgggttgaagagatcctcctgcctcagcttcccgagtagctgggattacagggacatgccaccacacattgctaatttttttattttgggtagagatcaggtttcaacatgttggccagactggtctcgaactcctgacctcaggtaatccgcccgcctgggcctcctaaagggctgggattacaggcatgagccactgtgtccagcctgcagcagctcaattttacagtgtcccttttctccttctggaaactatatagagcaacaacaagactgaggaggaggaggaggagaaggaggaagaaaaagcccatcatcaacatacacatcaaactcaacttcagagaaattaggaagctgggaagccacgtaaacccaaaagcaggtgacaccagcagaaccaacacaggaagccagggaagtgcagaagaacagggcatggggggccacccagggggaatcttcactgttgccagcaacacacactcccagcaagagaggaccctcagagtgagaacgcagagctggagaagtgaagaaaaaaggaacaggtggtgtgcggggaagtccaggggtgcgggatctgacagcgtcccttcccaagagaggcaggaacacttgggaaggcagggctgagtccctggaggctgtatccgggaaaggaagctggcagtagaaccttcctgaagccgagttggttctgagaggcagaggggcagtggtacaggtgaggccgacgcttctgtgcaggaagggcaggctcctgaggaagggagccccgaatgctctccactagattcccagggagtcccactccctccacagggaccttgcgctgacatctgggaaatgccattcatactggaacctccgacacactgccatgaatgtgagggtttcgtgactgatggggtaggtttctcttttccaattcaatagtataatttccatttattcctcccccagcctccctgaacattcacatcttagatagccacagtacggtgatcagaaccaggaaatccacattctcatatttaactatattaaaattatttcacaaaataaccaattttgttaatttaaatacatttaaatgacgtttaaatgtatttaaattatttaactatttaaaaatgaacatattagctaaactaaagaccttattggagttttgccactttttccactaatgtcctttttctgttcccaaattccacccaggatcacgctgcatttagttatttctcagtctctcgccgttttgtaggactgcaataacagttcctcaatctttccttatctttcataaccctgacatcttgaaccagtactgatcactatttgtcaaatgttcctcgatttgggtgtgtctgatgtatttccatgattggactgaagttacacacttttggcaattacagcacaaaaatgatgtggaatccttcccagtgcattccttcagagttatggcattgatagttcttcttactgatgatgttgaacttgttcatttggttcaggtttctgctggatttctccattgtaaagttactatctttccccctcatagggggaaagatcttaggagaaatacttggagactatgaaagttttgtattttctcaaactttaaaattttttttcaggccaggcgcagtggctcacgcatgtaatcctagcactttgggaagccgaggcagatggctcacctgaggtcaggagttcaaaaccaccctgatcaacatggagaaaccccatacctactaaaaatacaaaattagccaggcatggtggtgcatgcctgtaatcccagctactcaggaggctgaggaaagagaatcgcttgaacccgggaggagaggctgcagtgagctgagatcgtgccattgcactccagcctggataacaagagcaaaagtccatcacacacacacacacacacacacacacacacccacaaaaaaaaaaaaaaaaaaaaaaaggccaggcacaatggctcacacctgtaatcccagcactttgggaggccaaggtgggtggatcacctgaggtcaggagttggagaccagcctgaccaacatggagaaaccccatctatactaaaataaaatacaaaattagctgggcatggtggtgcatgcctgtaatcccagctactcgggaggctgaggcagtagaattgcttgaacacgggaggtggaggttgccgtgagccgagatcccgccattgcactccagcttggccaacaaaagcaaaactccatctcaaaaacaaacaaacaaacaaaaaacacctattttgacagccgggcatggtggctcacacctgtaatcccagcactttgggaggccaaggcaggcggatcacctgaagtcaggagttcaagaccagcctggcgaacatggtgaaaccccgtctctactaaacatagaaaaattagtttggcatggtggcatgtgcctgtaagttccagctacttgggaggctgaggcaggagaatcgcttgaacccagaaggcagaggttgcagtgagccgagacggtgccattgcactccagcctgggcagcagagtgagggatctcaaaaaattataataaaaaaataataattctattttgaatagtggtaaaatacacataaaatttactaccttaaccacttctaagtggcagttggaacaggggtcaaggagagcccttgggttgggtaatgtatattcacattgccatgcaaccaatctccggaactttctcatctgacaaaaccaaaactctatatccactaagcaacttcccattttctcccttccccatgtccctggcaacccccgttctaccttctgtttctattagtttgcttactcagtctggacgcttcacataagtgaaggaacaccgtatttgtctttttctaactggcttatttcacttagcataatgtcctcaatgttcatccatgttgtagcatgtgttagaatttccttcctttttaaggctgaagaatattttattgtatgtatataccacattttatcaattcatctgcctatggacaattcggctgcatccatcttttgacgagtgtgaataccactgctataaatatcagtgtacacatatttctatgagaccttgctttcaattattttggctatatacccagaagtgatattgccggatcatttggtaattctatttttaattttttgagaaactgcctgtcctgtgctgagcaggtctatataaacctatctgcaaaggccaaggaacctgagataccaaagaaagaggctgacaaatccagtttctcagaaagaaacatttaataggcgtttatgaacagaaggcaagtcagggatggcaccaagataagatggtggatccctgtgccatcacccccacccccccgacccagggcttctatagcatagggaaagggtaatgcgggcttcagcagggatgtgtatggccagacacggtggctcacgcctgcaatcccagctctttgggaggccaaggtgggcggatcacctgaggtcaggagttccagaccagcctggccaacatggtaacacctcgtctctactaaaaatacaaaaattagccaggcgtggtggcaggcgcctgtaatcccagttactcgggaagctgaggcaggagaatcgcttgaacccaggaggtgaagtttgcagtgagctgagattgtgccactgaagtccaacctgggagacagagtgagactcagtctcaaaaaataaaaaataaaaaataattttgttaaaaagataaaatagaaatcgtagatgaattcttggaactgggattaatcagaacatggcagattagcatccaacatggaattgctttattctcattcaaggtttccctcattcttcactctccccatgctggtcaccttgctgtttgttcctcaaacacatatgacatgcgtttctgtcttggcagtcatcctgctacctgtaatgtcagcactgctttctgttgtcccttcagtcaggtcactgttcaaatagctctctagacaggctcttccttatcattctacttaaaatagcccccaatcactctgtgtccctttagcctgcttcctcttcctgctatttcatactacctgaaaaaatacttgtttgaacttcctagaacataagctcataaaagcaagaactgtgctccacctctcctctcctctaccccagcactcagaagagcaacagagtcagcatccagtgagtgttcatgaatcaagtcactgcttggcagaattcagcactgggaccacagcctcgcctatcttcaactctttctccttctgcttttcctcctcccactctagtagccactcttctgggggcttgtcccttaaatgattagtccttactgacctattttctgtccactttatctgtttttgagagagggtctcactctgttgcctaggctggagtgcagtggcatgaatatgggtcactgcagcctccacctcctgggctcaagtgaacttcctgcctcagcctgccatgccatgtaactggggccacaggcatgtgccaccatgtccagctaatttcttgatttttttttggtagaaatgggtctcactttattgcccagtctggtcttgaagtcctacactcgagcagtcctctcaacttggcctcccaaagtgctgggattacaggcatgagatactgtacctggtcttattttttcttttcttaagatacagggtctcaccatctggcccaggctggactcaaactgctgagctcaagtaattcccccatctcagcctccaaagtagctaggactaaaggcatgaaaacaccatgcttggcttgtcccatttcattctacacactttcttggtatttaaacagctgctgttgctcttcattctgtagctctacatcagattcatgctctagtcctgtatatcaaaatgatgactagaggctgccggctccgctctttcaaaggcacaatgagcgtagcccgtctacaaaactctcccttttccaatccagctttccctcctgcatcacctatctctctacatctggaaccatcggcagctgccttcataaggcacctcggtctggcattcggaaaacaaccctgtcttgccagagcctcctggtcttgggtagcaaaagctgtatgcaatctaaatcaagctttcaatcatgagaaatcacattccttcttttccctttgtaatatactcatgtgtttttttttttccctttctcaatcagcaaattgtaccaccatcttattctgagatgctcctttttaaaagctgtagatcacattaatggaagtgtttactgctgggaatattttccatgtgcaatgatctgtaaccctctttttcttttcttttttttgagaccgagtctcgctctgttgcccaggctggagtgcagtggcacaatctctgctcactgcaagctttgcctcctgagttcatgccattctcctgcctcagcctcccaagtagctgggactacaggtgcccgccaccatgcccagctaatttttttttttttagatggagtctcgtttggtcgcccaggctggagtgcagtggtgcaatctcagctcattgcaagctccgcctcctgggttcacgccattctcctgcctcagcctcccgagtagctgggactacaggtgcccgccaccacacctggctaatttttttttttgtatttttagcagagacggggtttcaccatgttagccaggatgggcttgatctcctgaccttgtgatccccctgcctcagcctcccaaagtgctgggattacaggtgtgagccaccaggcccggccatggccagctaattttttgtattttttagaagagatggggtttcatgatgttagccaggatggtctcaatctcctgacctggtgatcagtccgcctaggcctcccaaagtgctaggattacaggtgtgagccactgcgcccagccaatctgtaaccctcttatctcaactaactgacattattacttcacatccagttcaatttataaattaagagaggtgccatgggccgggcacggtggctcacgcttgtaatcccaacactttgggaggccgaggcaggtggatcacgaggtcaggagttcgagaccatcctggctaacatggtgaaaccacgtctctactaaaaatacaaaaaattagccaggtgtggtggcaggcacctgtagtcccagctacctgagaggctgaggcaggagaatggtgtgaatccgggaggcagagcttgcagtgagcagatatcacgccactgaactccagctggggtgacagagcaaaacatcgtccaaaaaaaataaaaataaaaatgaaaaagaggtgccatgtgtacaaaaatcaatgcatatttatgaactttatttcaaatatattttcacacattttatctaaatacataatacagaagcctgtgtgacttgggcaatgtggccaggagggcctgagactaacaaatccaccttggcaaaaggacataaaatacgtcttatggtcagaaaaatcaacattttgtgtatttacttagtttacgaaaagtactgaaaatgctattattagctgaatttgtgatttccttttgaaattctgagttatccttatttttcccattttgtttttgcaccaaggagactgcagtcaaataaaacagatactacacacacttgtcggggcagccgtactgcagaagcacgttgatgcactcctggctggaggcctgccgggcgtaggtcagcgctgtgttcccgtgggcatctcgggccatgacgtccaccccgtaccagatcaggagctgcgccaggaccacattccccttgcggcaggccagatggagcgccgtgcagccgtctccctccccacaggtctcgttcacctcctcacgggagccatgtgccagcagcaggatggctgtctgcaggtcctcatcagcggtggcccgcagcagctgctggcccagggacagctcagtgcagggtagtggggccagaaagagcttctcctcatatttggaacggatccaccgttccttctcttccctcgtggacttttctgagggttttgtctgcccctggctgctcccttcccagatgctgttggctaggtcattgccaatagatgacataaccttcctgagctcaactggccagtcatccagctccagagatcgcacacgggaaaggcgggtgccaagactgcggtggattcctgagcattcaatacacatgaggactcccaagttcaaactggcccacttaggattctgggtctcacagtccacacagtgggcgttcccacgcatgttttggatcgactgcagggccatggccttgctctggctggtcagctgggacttgcttttactgctctcgcatgactgcaggctggccaggatctggctctggatggcttggacccaggcatcccgctcctcatacgtcgtggcttcaaagtgccacgtttggccagtggcagacacaatcataaagttgttggtgcttttcttctttaggtgtttctttttattggcatgaggagaggggggcgggttgagcttggggctggtggtgctggagatactggggctgaagcatatggagtcacccagcccggtgtccatgtccttggataggccattgcttttagaggtggagatgggtgtgcaggccgatgtggctagggatggccactttcctgggactttgatggtagatgtctgaaggtcaatctcttttttatgaatattcttcatataatcacctaagcttgaataataggtgagcacgccattggaacacagggtgacgtatttctttttccatgtcttcagccatttcccacttcgctttaagagcatgccctgtttaatggggatggctctgccgctcccgatggtgtcagcatgattctccggggctttcctctctttgtctgggtcactccctttctcagatgtaaacaggttggaccagcgcatggaccgcttgcaaacgggggtgggtgtgttggcagtgggaggaacactgaactgagggtcctcctggctggtgctgggagtcgatggaatggaggaggaatagttatttaaactcccacctccatttcttttcttcataatgtgcacggtggaaacctgtgtggaacagaaggaggaatggcttcaaaaattgggtagtggcttgcagggtcctatagacagctcacaattaccttttaaaaagatacattttctgggccaggcatggtggctcacacctgtaatcacagcactttgggaggccaacgtgggtggatcacgaggtcaggagttcaagaccatcctggccaacatggtgaaaccctgtctttacaaaaaaaaaaaaagaaaaaaaaattagctgggcatggtggcacatgcctgtaattccagttactcaagaggctgaggcaggagaattgcttgaacagggacctgggaggcagagcctgcagtgagccaagatcgcgcgattgcactccagcctgggctacagaaagagagtccataaaaaaaaaaaaaaaaaaaaaaaagatacattttctgttgtttggatagtatatttactcatactagctcactaactaaacagagctgcagatcagttcttactccagcacattctttttacaacacttaagatgactaaatgcaacatgaaatggggaagatttaaaaaaagatggctttgacttcagcatgaaacagatacaagtgtacgatgaaaatacaacctcaataaaagtgccacttaccgcaaatgagtgtaactgttcatcaggtatgctcaaagatctatctgcatctctataaaataagaaagcgcattacttcaaaaactgttaatatcttagtataatatttgtttagtaaaatactgcctcctgtgtgctttggtgtttactttaccaaagcagtttttacgaattcttctcttggatcctgacttgcagagggtttcctgacttcttctttctcagcacatcatggcctgtaccgtgaagtcttttatatgataaccagtcagaaatgcccgtgagtattgactctccctaacaggccatggcaataaaccaaacatattttcactcttctaaccacacattgaaacacaagaatgttctacaaagcagttgtagtaaactttaataaatgtaaatgtgattcagatttcctagcttcctttctctttagttctctgtagtatactctcatgatgtatttatgtactttctgttgtttgaatgacaaactcatctgcctttttaagacgccagtctttgatgaactttaaactttgtaaaactaatgcattgtgcctgtgtataaaccagtggttctccaaatgtgctctgtggacctctcgggatcccgaagaccccttccagaaggcctaagaggtcataactgttctttttttttttttttttttttttttttgagaccaagttttactcttgttgcccaggctggagtgcaatggtgtgatctcggctcatggcaaccttcgcctcccaggttcaagtgattctcctaccccagcctcccaagtagcagggattacaggcacctgccaccactcctggctaagttttgtatttttagtagagatgtggtttcaccatgttggccaggctggtcttgaactcctaacctcaggtgatccgcttgcctcggcctcccaaagtgctgggattacaggcctgagccactgtgcctggccaacactgttctgaatcatactaattaaacctgagaaagctgatgaaaaattttaaaaatttgtgaaagtaatacaaagtcattgcctgctttttcattgacacttgccatgattatataaaagcaaaagtgggtacaatggctggtttctcagcataaatcaaggcagtggtaccaattacattagtagtcattctattcttcactgtcccctacaggtaaaaaacatagcctgaatttcttaagaatgtctttgatgaagcagtaaaaattaatgttgttaaatcttgacatgtctctaatattctgaataagtggaaagttaaccagaagcgctttttttttttttgtttttaaagaatccgtgatttaactgtgaactgaaaaatcacttttttcacagaacatcatttttatttaaaagtacaactgggccagcgcagtggctcacgcctgtaaaatcccagcactttgagaggccaaagcaggcagatggcttgagctccttcaggagttcgagaccagcctaggcaacataacgaaaccctgtcactgtcaaacatataagaaaattagcctggcgtggtgccacacatctgtggtcccagctacaaaggagcctgaggtgagaggattgcttgagctgagatcatgccaatgcactccagccaagtgacagagtgaaactcggtctaaaaaaccagttcaactatcattctcaaaaataaatgaagtgagaggttgtcacttcaagggaaatacgtatttgttcccaatgataaaatttaagctttcctgtggactttgaaaaacttgttccttctactgtaggcttggcagcttttcaatacttaaaggcgtgttaaagaaagattggtggttaaactaaaagtgatttttgacacaataaaacataaaccaatatattccaagtaactaatgcatgatattataaatgcaagtatggagcaaaagatccatttactgtgcaagaaagatcaatgagtactgatggaataaatttattaatatgtaaaatgccaccgtaactaatttaagaaaccaccacttgtgaagttttgatttagtgttaacaaatacccacaactgtctgaaaactttaaaaatacaccttctaccaactacatatttgcatgaggttaggtcatcttattgcttctttttttctttttttgagacagagtcgctctctgtcacccaggctggggtgcaatggcgagatctcggctcactgcaacctccacctcccaggctcaagcgattctcctgcctcagcctcccaagtaactgggactacaggcatgcaccaccacgcccagccattttttgtactttcagtagaggcgggttttaccatgttggtcgggctggtctcaaactcctgacctcaagtgatccacccacctcggcctcccaaaatgctgggattacaggtgtgaaccactgcgccccaccagcttattgctttttttgtttgtttgtttgtttaggcagagtcttgctctgtcacccaggctgcagtgcaatggcaccatctcagctctctgcaacctccgcctcccaagttcaagcggttctcctgcctcagcctccagaataggtgggactacaggtgcgtgccatcatgcccagccaagtttttgtatttttagtagagacggggcttcgctgtgttagccaggatggtctcgatctcctgaccttgtgatccgcccgcctcagcctcccaaagtgctgggattacaggcgtgagccaccgtgcccaacctcttattgctgctttaaagcaaattgcaaagaaagctctagagaatccatttgtctcctattaagctcaacatgagagactttaaataatataaatacatgacgcactttttactcaactttttgttgtagaaaagttatttttcaatgaaaaaattctgttaacaatactgttctcaaggaatattttctgttgttataacctgggtcatgggttactactgatatctagttggtagaggccatgaatactgctaaactctctgcaatgcacaagacagtcctcacaacaaagcattatctagcccataatatcaacagtggtaaggctgtgaaatcgaaactaaaaatagattttgaaaaaatttcaattgtataattctaccacactaaatatcaatataatcaatataaacacatactctttgagattctcaatcatttaagaattatgagagtcttaaggaacaaagaaaatacaaataatttgcttcaatattttagtaggcacaatacagcttatgatgtctagagctgtgacctaacactgagcttgatatcttgcaaagtacttagctagaataacaagacaggtttctaaaaagctcacctttgtgtgatatgatgaggtatctccaaggtcacactgtggaaggaaaaaaattcataacaatagatgttaacatttgttaggcctgaagacattttttaaaaggggggcagaggaaactctcctagtggccctgaaattcaaatcttctagttcagaacagtaccataagggcactttgttttcatttctttgttttttacaaaaatatgagaaccaaaatgcaaggaaatatgccgttagaagacgcgtttctgttggtgattacaatatataaataataacagatttccttgttatatgcttttctacccacgaaacctttcgtcccatgcgatttattttatgtatttatttattttttgacccagagtctgtctctcttgctcagactggattgcagtggtgccatcttgactcctcacaacctccaccacccaggttcaagcgattctcatgcctcagcctcccaagaagctgggactacaagtttgtgccactatgcccagataatgtttttttggggggtggggtggatggagtttcgctcttgttgcccaggctggagtgcaatggtgtgatctcggctcaccacaacctctgcctcccaggttcaagagattctcctgcctcagcctcccaagtggctgggattacaggcatgtgccaccacacccagctaattttgtagagtgaggctcaaaacaactgagggaaggcaaatctcaattctactaataggtctacacaatattagcactttttaaaaagcctgtaacattagcaggtaagatggatatgtctatagtgcttcaagtagttttcatctctgaaataattttaaaatcacagaatttaaagttacatgctggaaaggaccaatgaccttatgtgacatttaattcaacactcgttttacagatcagggaaacagaccttaaaactgacttgcccaaggtcccaccaaattggagcagtttctcgtcctaaactcaaattaagcagtggctgtcaaactttgctgcacattaaaatcgcctgagaagctttaatatctgcctcatcttccacatgagacattttaatttaattagtattgggtatggctttgggcatcaaggttcttggtaaacatttcccaggtgatttcaatcagcagcaaagtttggaatgattgagttggggtgaaaatcagaatcttctgggatgcttttcttcacagaaagatgcctcacatccatcccgattttcctaaaaggcttctcagtgcctagagatagagggaaagtggagatgggaagatacatgtgtttgcagacttgtattttgaaaaaaaccttgcataagtgatctcagcgagttccacctatcccactgacaacagtgcactactgattcatgataaaacatttttcaaaatatcttcttgaagccaatttgccctattaatttgttcaataactttatttcaccaatagtgaatacaccaaatgatcatttctcaaacttgctggtggcaaattaaaacttactatactctcaaaagtagacttctaaaaagtagaataatgaggaaaaaagcacgaaatttgtttcagcaaaattaatcttcaaagctgcttttgaattatatgctaacatatcaaaatctttggaactcagaagaagccagggactctagtcaaagtaatttttgtgtatgtgtgctcagagatttaagagacttagctgactacagacatttagtgattactcaataggtcccaaagctcaggacttgagacagagtttgagtccagtttttgttcgaaacacaatttcctctcaactattgttaaaagggagggaggaaagtgacattattatgagtgtaaactttccacttttaattgaagtaaaagttattgacaattgaattagttaaaaaggctagtgcatttgaaacaaaattgtttataagctagttatgtgtacagaatgaaaagttaaattaaagataaagacattaatattctaaattagcactttccaaactgtgttctaaaaatcaagactaataacccaagaagatgagaataatgtacactggacagcccctgtggagctggtggtggtgttggttgttgttccttttaaaataaacttcatctcagggtgctctcaaagcgcatctttgtggcccacgaggtgctcatgcacaatgggagaaattcaaatgcagatacactgtggtgccagaagaagaaaagctgttccttcttccaaggataatgtccaaagtagtgcacactgatttaggcctatgatgcattgaaaaactaagtttccacaaaaaacattcaataaagggaacctatccttctcactgtgttcaacattgtctaaaggcataaaggcatcaaaaagatacactgtttctgggattgcttctttgctaactgatttttccttccaccacgacgtctaagattaaaagagaaactgatacttaatattcagaatctggatatcaatatatggttgactccaatttcttaaactgattgctgaaaaggacaaccaaatgactgaaataattttagaataaaggaatctgtccctcggcagcatagttgtactcacgatattattgtcattgtaagataatgctggatggctgtgctgtcatcaaggaatattgtcgaacacaagctgtattgttgactgaaacgcacagtagatacctgaaggggaagggaagtgtaagtcaaacttatcaaagtgtattattttctcagttaaaatgtcaaatgacaaagcactaagatatgtcttacactccatgaaatgcctgagtgtggtatcatgtgcactctatagaaaacccattggaggctctcaacttccagagatgatgtttaagatatgggttataaaatgctgcccttaatatggtacctgtcatcaaacctaacaaggattttatgaattaccgttaaaaataatgggaaaagtcggcttcgcggggcacggtggctcacacctgtaatcctagcactttgggaggtggaggcgggcggatcacgaggtcaagagatcgagaccatcctggctaacatggtgaaaccccgtctctactaaaaatacaaaaaattagccgggcgtggtagcaggcccctgtagtcccagctacttgagaggctgaaacaggagaatggggtgaacccaggaggcggagcttgcagtgagccgagttcgcgccactgcactccaggccggcagacaaagtgagactccgcctcaaaaaaaaaaaaaaaaaaaaaaaagaaaagtttaaaataagatttcatttttttttctgcagcaataaaaagcagctgagaatttctattaattaattaatttatttatttatttttgagacggagtctcgctctgtcgcccagactggagtgcagtggcgcgatctcggctcactgcaagctccgcctcccgggttcacgccattctcctgactcagcctcctgagtagctgggactacaggcgcccaccaccgtgcccggctaactttttgtgtttttagtagagacggggtttcaccgtgttagccaggatggtctcgatctcctcacctcgcgatctgcctgcctcagcctcccaaagtactgggattacaggcgtgagccacggcgcccagcccttctattatttatttactacgataaaatgtaatgtattaaataatcctgctacaagagcattttattgcagtgaatacaagactaatgcatttactaaattactaatcctaaatgtattatttcaggtgatattgttacaaaagaagtgtttcagattcagaggctctgtgtgtcagggctgctaggccaccaacaagtgaggaagccataggtttctctagtcctattttcttatgtggaggataaaaagagtatcacttacatattctctcacaccctgaaaacaaatgacaacttaaaaaatctaactttcacttcatgtttaaataagactgccaagacatgactcaaatgagactctcggagaatactttgcattcacttcaaaacttgatcaattgcattctataaatcatctgacctgcacctagccattttcctgctctacccctgctctctgcctagaatactgcttttctctttccttgcttcagcaagctcgactccatctaccctcttggatctctttgtcggcagccacaccaaaaaatgtatttttatacactaattagttgaattcaccactgcttacaagatgctaattcctgcagagtattccccttgtgagaaagtatgcctctccataagagtaagggagggcccttactcttcctacctccagctgctgagcatagaattttgagtaaatccaaaacttcgacaagtgtttgacaattcagttatcatttggaaggtaagtcttactacatttaattacagcaaaaacactactaacagtttactctttataggtattatttaaggtagtcacaaaatagaaacaaacactctaacgtcaggcagcataaatgagagtatgaaattttacaatatttaacaagaaatggaaggggttacttagtagttttaaggtttaatgacaaaaactagaaaataatcgtacctagtaatttagtaagtcaaaaccaaagccttaccatcaaaggtgcagtacccattggatgcggatgcccacgcactgacttcttctgctgtacctgctgcctctcattttaacccattaaaaatactaaagttgttttccttgtagacatctttcacctccttggttaggtctattcccaagtattttattttagtttagtttagttttgcagctatcagaaaaggggttgagttcttggtttgattctaagcttggtcgcttctggggtataacagagctactgatttgtgtacattaattttgtctcctgaaactttgctgaattcatttatcagttctaggagctttttggaggagtctttagggtttcctaggtatatgatcatatcatcatcaaacagcaacagtttgacttcctctttactgatctgcatgccttttattgttttctcttgtgtgattgctctggctaggccttccagtagtatgttgaatacaagtggtgagagtgggcatccttgtcttgttccagttctcggggggaatgctttcaacttttccccctttcagtatcatgttggttgtgggtttgtcatagatggcttttattatattgagctgtgacccttgtatgctgattttgctgagggttttaatcataaaaggatgctgcattttgtcaaatgctttttctgcatctgtttagatgatcatgtgattttttgtttttaattctgtttatgtggtgtatcacatttattgacttgtgtatgttaatccatccctgcatccctggtatgaaacccatttgatcatggtggattatcttttttttttttttgagatggagtctcgctctgttgcccaggctggaatatgcagtgtggtgatcttggctcactgcaacctctgcctccgaggttcaagcgattctcctgcctcagccacctgagtagatgggattacaggtgagcgccaccacacccggctaacttttgtatttttagtagagatgggatttcaccatgttggccaggctggtctcgaactcctgacctcatgatccgtccgcctcagcctcccaaagtgctgggattacaggtgtgagccaccgtgcctggcccgattattttttgatatgccgttgggaactacaaaacgttgctgaatgaagtcatggacacaaacaaatggaaagacaccccatgctcatgaatgggtagaatgaatattgtgaaaatgaccatactgccaaaagcaatctacaaattcaatgcaactcccatcaaaataccaccatccttcttcacagaactagaaaaaacaatcctgaaatttatatggaccaaacaagaaccggcacagccaaaacaaaactaagcaaaaacaacaaatctggaggcatgacattacctgatttcaaactatactataaggccatagtcgccaaaatagcatggtactgatataaaaataggcacatacaccaatggaacagaatagagaacccagaaataaactcaaatacctatagccaactgattttcaacaaagccacctaaaacataaagtgaagaaggtaaaccctattcaacaaatggtgctgggataattggcaagccacatgcgggagaatgaaactggatcctcaactctcagcttacacaaaaatcaactcaagatggatcaaggacataaatctatgacctgaaaccataaaagttctagaagataacattggaaaaacccgtctagacgctggcttaggcaaagacttcatgaccaagaacacaaaagcaaatgcaacagaaacaaataggtgagacttaactaaagagcttctgcacaggaaaaggaacaatcagcagagtatacagacaaccacagagtgggaggaaatcttcacagtctatacatctgacaaagggctattatccagaatctatgaggaactcaaacaaattacaattacaaaaatatggaaccagctcaaatgcccgtcaatcaatgagtggataaagaaaccgtgatatacatacatatatatatatatatgaggaataccacctcagccataataaggaataaattcatggcattcccagcaacctggatggaagtaagactattattctaagtgaaataactcagcatggaaaaccaaatatcatgttctctttcatacgtgggagctgagctatgaggatgcaaagccataagaatgatacaatggactttggggacttgggggaaaggctgggaggagggtgagggataaaagactacaaattgggttcagcggatactgctcaggtgacgggtgcacctaaatctcacaaatcatcactaaagaacttagtcatgtcaccaaatgccacctgttcccccagaaacctatggaaataataaataaataaataaagtacagcatttttctcagcaaacataaaataaaacaaagactaaagttcatatttttcactctccttttgggcaggacaaattttagataggtttttaaagaattagtaacttttttcctttttccgagacagggtctccctttgttgcccaggctggagtgcagtggtgcaattatagttaactgcagcctcaaactcctgagctcaagcgatcctctgcctcagcctcctgagtaggtaatacgaaaggcgcatgccaccaggcctggctaatttgttatttaacctttttgtagatatgaggacttgcgatgttgaccaggctaaaaatgaacaaatcttaattaacttaaatatttctaacactttgggcattcaggaaaacagctccatctatgttgtgaagtaatgggaagtatatggcagtggataaactttgaatgaaaatattaaacaaggccttaggagaaaagtgtaatatgcttattatagatacattaatttaaaaaattctctggcttaatatcattaattatactcaaattagactttgatttaaacacaggtcctaaatttggattaaatataatagattgaccacaaatttatttcgtctccctccggaagcctcatcagtcataaaataaaggttacacccatgaccagcacagaaggttgacagagataatttttaataaatgctgagacataaaaagtagataaaggagtggtaaataacacagaaacacaactttggtgcctacagaaagtgactggaacagaagcgagccagtttgtcttgcagaactaaaggcaggttgtgaacttacaggcaaatggcactttggaaagtagggtaaaatgtgaaaaaaaaaaaaaagccagcaaggtcagttgcaaatctctaactagagccccaagtccacctgtccttccatctgacaagaaacttagatgtgtgttctctggatatatcaaacctgagaatttctggctcagagataccatggcttaaacctgagatataaagaaaactgtacaccaaaaatggaactccaactttcttcgctaactctgcttttcctttccaggcctgcttttactttccaggcagaaaactgggagatccttctcagaagaaactgaaatgtcttcaaaaaagatccccagataatacactgaggtctcccaaatgaaaagctagtcaggcttctaaggcctcacactgagtgctatcagttaacagaaatcctgcttccaaataaagcaggccaggaaccaccacacattggagggaagcctccaagaaaagagatcaaaacaatagaaaaaaggaattgataggaccagtcaaaatcaggagcaaaactttaaaaaaaaatcttaaaacactctcaaaaaatataaaattcaatagaaatagtagaggataaagtcacagaatatcccagaactagaataaaaagacaaactgaaaaaaatacaaggggaaaaattaaaaatcaatgcaggcgtactggtctaagcagcctagcatctgaataacaagactatcagtaaaaaagtaacagagaaaataaaaaaaaaaattctcaagaagagatagtctgcaggtttagtagcctcaataaaatgaaaagatccccaacaagctgttataaaatttcagaaccttagagagagagattctaaaaagcttccgcagataactaaaacctggttgtaaataacatatcacacactggcaatagattcaagaacaacactgtaataagagcacaactgcaaaatgtcttcagaaccatacaatttagattcaacctagaggtgtactctctatcaaagaggagggattttaacatctccacacaggaaaatgtgttcaagtacaactagagacgataacaggacagaaggaaacacagaatctaggactcaggcgatcccacacaagacagcagttacatgagataccaaaagactttaaagagttagcccagaaaagcagacattgagcatatctagggaaacccacgctatattgaactaggatgacaaaaggccaaagaaagttgccccccacacaaacataaaaaggaacagatgtgttttcgcagatggaaaatatctttgaaaggcatgtgataaatgctacaatacttgggggaaaacagctgttagaaaacaggcaaatgaatatagtcagaaaattagcttcatgctaaaaaataatggatgtgaaagcaaacagagcacccagaggctacttaacgatatttggatagataaactaacgtaggctaggaaaaaagaagatccaggagaattgcagaagtgctcagatttcagaactgtttcagagacaggatgaaggacatggaatgcagaggcacagtgaaaacaccatatgacttagcagtgaataatatttgcagagtcataatcatgtaaatattactgatttaattaaaaagtgtgctacaattggaagaaacacagggagaaacataagatcatggtgtagcggggaaggtatgcttttacctgctgtgacagaaagtcaatagacagtgctggcaattaacttagctattctatttttgttctttcattaaaaataagattaaatatttaaggcaattttttttttttttttgagacagagttttgctctgtcgtccaggctggagtgcaatggcgcgatcttggctcactgcaacctccgcctcctgggttcaagtgattctcctgcctcagcctcctgagtagctgagattacaggcatgcaccaccacgcccagctacttttgtatttttagtagatacagaatttcaccatgttggtcagggttgtctcaaattcctgacctcagatgatcagcctgcctcggcctcctaaagtgttgtgattacagacgttagccaccatgcccagccttaaggcagatcttttgaaccggactattgaaatttaacttaaatgtcagaaatctttaaaaggtggacacgctaaactaagcacttttctggataaatttaatactcaggaaaatagaagagatttagaaaatccacaaaaagaggtccatgctaccaccaccaggtccacattgtaatttaaagaaatcaagagagacatccttttatgtcaaactatcaatttcttaactatttgagtgtttacttacatggtttgtacagttgcttcttcttatttctacaactaagaataaaaaaaaaaaaactggtcacttctgatacaaataccataaaataaaagtagttgttaacatcttactgattactcctatgaaaaatgagacaaaattccattaaaaaaaaaattttcaataacatataatttaaattatctggcatgattaatttcataagtcaaatctaaaaacttagattttcatttagtttactttttgtttctattacacacaaatgaaagaatcctcatgtacaaaagaaaagggcaaaaaaattaggccagatgaaaaatttagctaataaaaagtttaactgttgcatatatgagccatgatccattagtattctctcattctgcatttacacatagcttactttaattatcagactctaagagctaacagttctaaaaactacttcctgaccagacacctatctctagatgcaacagaatccctgtaagcatcttgaaccacacttagtggttatctactaatatgtcactaaaaacaaaacaaaattaaaaaatggtctttacacaactggaaagtaacctatcttaaatttgttttcttttttgagatggagtctcactctgtcacctaggctcgagtgcagtggcgggatctcagcgcactgcaacctctgcctcccaggttcaagcaattcttcagccttagcctccggactagctgggaccacaggcacgtgccaccatgcctagctaattgttttttgtatttttagtagagacagagttacactgtgttagccaggatggtcttgatctcctaacctcgtgatccacccacctcaacctcccaaagagttgggattacaggtgtaagccacagagcctggcctaaattttgatgttaaaataagtatacaaacctaattggacatggtgtctgcagcacaaaaaatcattttttttccctaaaaagaggccagaataataaaagccccaagagggacttgggccatgctttgtttcctacactgcctctgcctttgatgctgggagggccttgtaggcaaaagttactaccactgaagagtgagggacatggaatagcttttcttttactgcttccatgctctctaggtgtgagaagcccatgcctctggaaggaactgggaaatacaattctgatatgttttggatatgttgcccctccaagtctcatgttaacatgtgacccttaatgttggagacagggcctagtgggaggcgtttgggtaatggcagtggattccttatgaatggcttggtcccatccccatggtaataagcacattctcattatggtaatttaaaagactgtggtactggccaggtgcggtggctgaagcctgtaatcccagcactttgggaggctgaagcgggtagatcacttgaggtcaggagtttcagaccagtctggctaacatggtgaaaccctgtctctaccaaaaatacagaaattagccaggtgttatggtgcccacctatagtcccaactactcgggaggctgaggcaggagaattgcttgaacctgggagatggaggttgtagtgagccaagatcgtgccattgcactccagcctgggcaacagagtgagactccatttcaaaaaaaaaaaaaaagagtgtggtaccttcccccttcccctctctcctccctctttcacggtgtggaaccacctgcttcccctttgccttttatcatgattgtaagtttgctgaggccctcaccagaagcagatgttaaagccatgtttgtacagcctgaaaatctttgagccaattaaacctctttttgttataaattacccagccttaggtatctctttatagtaatgtaaaaaatgaagacaaattctaaccagaaataactgactcaagatgggcaaagtctactcaaactataaaaacaaaggttacaaactcccgtgttttactgtgctgcattacttcgcacattataatagaaccctcacttgtgttcttgctgtttaagtcaactggaaaacttggctgtgtatggcttgttggcaaataaatgaggatttaatataacattaagggaaataagcaggagtaaggcatgtttaaatttacattatatcaaatgaaaaagttaataacctaaaacttttgagtagcgtaaacttggatgtggtaaatgaatgtggtcagaggactgtgtaagaggaggcccaaatcacagattcaatccctgatgataaacgactatgttttttaatttgtttaaatgaaaaccaagctgaagttctatcattcatctttaaaatgtactttttggagcaagggaaaagggattgtaaataaagatgaatccattaattataaataaagataaatccaagaattataaagagaaatccatgactcctccatcacatcacaaattaattgtgttgataaaaagatggcaaaatgtataaacaaaaaggttacacgttttcactaacatcataacaactaaaggaaagtatatcacatattaaaataagacaagggaacatgtgaaaagatgaaaattttaaaccaatatgagtttttctaaatactttctataacctgatcaaacaagagcttttattctttctcttggtggaaaaaacaatgtcgtctcaccatctgtttgagagttcctctggaatattgtgcttgcctctggattggcagaagggttaaactccaaagctatatgcatagaggaagaaaagaaaaaaagatgtaatcattgataaaaatttatcaactcgtttattcgactgctgcatttaggctatttcactatctctactttgattcttatccattgaaatgaatgtatagacataagagagagccaggcaagatggcacatgcttgtagtcccagctactcaggaggctgagatgggaaaatcacttgaacccaggtcaggaagttgaggccagcatgagtaacataatgacaccctcctttatttaaaaaaaaaaaaaaaaagaagaggtaaattttggctttgagttgtgtaaaatcaactttgcataaaataaatcaagatggcagtaagttttaaaagacaggtctattttataggcaaaatataagatgtattctagagtttttaaaatttttaaaaagtaaattcatcatatctgtcacttccatttcattctgaggacacagaaccttagttctcttgagtagctgtcttccatagtcatgtgatatctctaagttttcatttcttcgttagcaacacatagggagaacatacacaggccttatttgtattggaaagggccaagtgagacatacataaactgtgttgtaatcctaaagaatgacaataaagagccatttttgggctctcatccaacactacccatctactaactggtgtgtaacatccatcaggctttccgaacatcaccaagcagagtataagtttacacaagtacttacatgctttgtgtataaaggtacaatcaattaattcacataatacatttgtttattctaaagcaatccttaaatatcttgaaatgtgaagatagtacttccaagttacaaagtcacactcataatgagtcttaattatcctacctctttaaaaattaagagcgcaaccaaagtttaaatagaagagctataagacatttcctctacagtgatgaaatctctggcatttaaatgaaaacaataagcctactggatgtaatatgtttatgatgcaatgttttctattttgaaaatttcagtttttattcaagaaccatattattacccagaattacttttacttagattcatctctttgcaaaattttagaggcaaacgaactaattgttttctcttttctaccggctcccatcccctgcctctgccagcagtgtagagactaaaaaactccaactttctttcctttttttttttgtgagacggagtctcgctctgtcacccaggctggagtgcattggcgtgatctctgctcactgcaacctccacctcccaggtccaagcaattctcctgcctcagccttgtgagtagctggaactacagtcatgtgccactacgcccagctaatttttgtattttttttttagtagagacagcgtttcaccatgttggccaggctggtctggaactcctgacctcaggtgatccgcctgccacggcctcccaaagtgctgggattacaggcgtgagccaccaagcccagccaaaactgtaactttcttatctttgaacaagatgctattgtcaggaggggaagggacaaagggggagccatggcaacaaacactcttacagggaaggtctgacattttaacctgcaatctttatattacacattgaaagtctacattgacgtttcatgtcttttgaaagttttgaccatgaaccaatccccacctctcttttagaacaaggaggtaaataaagtctgttaagtcaccagaataaatctggagacacattttctgttaaagtaagaactttaacagaaaagagcttcataggtaaactcctttgagaaaccccaaacacacacacacaaccatttttctgcagccccggctgtgacatttcacacctttcacaattattttaagcactctccttttttctttttccttctgtgttcaaattacagttagaagaaactaagcagcttctatcaaggtgacttaaagcagcccattaagaataccatatagcctctcccatggcaaactccattctgattttaaataagaaatccccaaatatttgaataggaactgtcttgagatttggctactttaacaaaggaaacaattaggcacttacctggttccttcacttaggtaccatctggataggtacaaagaaaaaataagatgggtactgaaaagttgggatatttgagtttttattgagaaaaggaagagaatagctcaaagaagcctaaacaaagtcccacaggataataaacagagctacagacactgttgtctcaccatctgtttgagagttcctctggaatattgtgcttgcctctggattggcagaaaggttaaactccaaagctatatgtatagagggagaaaagaaaaaagatgtaatcatttataaaaatttatcaactcatttattcaactgctgcttattcgacaagagccataaataaatggtcccatgccagcctgggagaatgagatgagagagcaagaactgggcgattgggaggggaggcgaaaagaaactgactggactcggtggggaaatactaaggggtgggaattcaaggcagagccagcttttgttcctggccagctcccgggaaagctggctacaagcagaaaggagctcgaagtgggggatgcctcaaagggaaccttggggacagtagcagccagaggcaaaccgagggtagatggcacctatcacctcctcaccttcaggcatctcccggtcacgaacgtggtgcatgtggaggtcctcaccaacttcaacagtcacctcagcaggctgtacagcagcagccatgggcgctcctgccatcctgtccccagctcctgcctcatagatctcagattcagagggacacaccgacccctgctgctggtcaaactcgaggctgacgctagggtgcacacgacaggtcagtatgttccccatggggcgcctctactgtctgccaccacctgtgcctctgctcacagctttggccacgcactcccgctgtcctaggccgaggctatgctgcacttgcagagatggtcttcccgctcctcgcctgcccacctcacagcgcggccccgggcaccagccctggccctggccctggccccggccccggctagggctgcgggccaaggcccgcaccctgctgcctcccctgagttgacttgtctgggagggtgaagaccagccggcttatttaataggttgtgaacccaacaagtgctgagagacacaacaactgcctgaagagagaacagacggagctcctcctccttctgtagtcacctacagactgaagcccactggccccaggtgggagcccaggcatgtggcacacaatgccccaccccacacttcacaatgccctccccgacacctcacagtgccccaccctgcctgccacccctccccaacagctcagaatgcccctgccttggctgccccaccctgtggcttatgatgctgctgctctcctggcccctcgtgcagtgccattgggactaaggttttcattcatcaccagcttcctgagattttagtcctaagaaaagcaaagggtagttcattacttgaagccatcttcctctatgagttctatacaaagcctcagtagagtgggtccaattagcaaccaagttgaacaacttttatttgctgactaaatatagatacacctgaattgttgactgcttttgtaactaaacactcctctcctgtcttccaacgagtggtcatttttgtccgcaacttgaccacagcaatccctggggccctagctctactctcaataaagagttatggctgtgtgttttgaatgacaccttaggacccatcctgcctccacctccttctccataaaatagaaacctaacttgcccctccaagctctgaaatgctgaaacttaccaactcccttttctccccgctatttcttccttccgtggcagggactttcaggttttctttcttttactaacaaggcactaagcatgattttctcatacaaaatcgagagccataaagtggcttaccacagtcctatttcaataaagatgaatactcgacatctggcaagtagtgtgtgcctgacagtgtccccactgtgctatgctcatttaaccctcagaaacaatctcatgttacagattttgcagaagttgttgagacggagaaggtaagcaacctccccaaggtcacatgactgctaagggtggggccatagtttgatcccagctagtctgaattccccagttgcttaagcatgattatcagaaagtatagcagtctgttttcacactgatataaagaaatacctcaggttgggtaatttttaaaggaaagaggtttaactgactcagtttcacatggctggggaggcctcaggaaacttagaatcatggcagagggggaagtccttcaggaaacttacaatcatggcagaagggcaggtccgacttccatggtggccgcacagagagtgggaacatgtgaaggagcaactgtcaaacatgtataaaaccatcagatctcagctgggcacggtggctcacacttgtaaccctagtactttgggaggccaaggcaggtggatcaactgaggtcaggagtttgagaccagcctagctaatgtagtgaaatcctgtctctactaaaaatacaaaaattagctgggtgtggttgtgcatgcctgtaatcccagctactcaggaggctgaggcaggagaatcactggaactcaagaggcagagactgcagtgagccaagatcgtgccatggcactcctgcctggacaacagagcaagactccatcccaaaaaacaaaacaaaacaaaaccctataagatctcatgaggacttactgaatatcacaagaacagcatgaggataactgcccccgtgatccaatcacctccccctaggcccctccctcgacacatcaggattatggggattataattcatgatgagatttgggtgggggcatggcaaaaccatatcagaaagtaaaggtagaagtcaagcttggatgggaaatgacattgtagatgatgatgatgatgattattattattattattattattattttgagatgaagttttgctcttgttgcccagtgaaattgtttctctaatttcattttcagattgtgtcttgtagatgtatagaaatacaattgataaatgattctggctattaaccttttatgcttcaaccttgctgaacactattttttttttttttgagacggagtttctctcttgttgcccaggcaggagtgcaatggcatgatcttggctcactgcaacctccgcctcctgggctcaagcgattctcctgcctcagcctcccaagtagttgggattgcaggcatgcgccaccatgcccagctaattttgtatttttagtagagacggggtttctgcacgttggtcaggcccgcctcagcctcccaaagtgctaggactacaggcatgagccaccgtgcccagccagattcgtatatttttaaaagaattttttttttattttttttgagacagagtctcactctgttgcccaggcagtggcacaatcgttgctcactgcaacctccacctcctgggtccaggtgattctcattcaagtgcctaagcctcccaagtagctgggattacaggagcccaaccccatgctcagctaatgtttgtattttagtagagatggggtttcaccatgttgctcaggttgatctcgaactcctgacctcaggtgatccacctgccttggcctcccaaagtgctgggattgcaggcgtgagccaccactcccgaacagaacaacatttttttgatgtggattttaaaatgcctccccttctttcaacattgattaagtcccttctacatgccaggcactgtatgtgtgaaatagtcccaactctcaatgagtgtaggcagatacacaaacaaagccttaaggaggtcagttttctgagaccatactgctggacagtatatgaacctgggatacaaacccacctctatttgacctcaaatttgatgctggggtggttttaattttattctgggaatttcagtcattgaaccatgaaaaggtgaaaagtctctgtcagatgtgtgtgtagtggtctgtataataaggactgaaggaagcaaccaaacaaattaagagactttctctaaaggcagagtaatgctaagggcagtggcagtgacaaaagcggaggaaaaagtctgtgatcatttgggagacagaataggaagtgcttggtcatgagatgtgaaagaagaggggaagtagaaggaaaacagagctgctcaggctctgctggggaagactgggtatgtagcagtgccttcctcctggccaagaatgtaggaagagaaataggtaaggaggaaaagacagttttttactctcagtgtcacattaaaatggaactctctggtcaaaagttgaatataaatctctgtaggctaagtccatttgtgacatcccaacatatgttttcaaaaataacatacatactaaatcaagccattaagcgtaactggggaaatttcctaaaatttacatgctaaaaaatcaccatttttcatttattagtttcatggagcaactttgaatctatggttacagcaattgaggcaccttgtataaaataaagctaatacatgaaaaaaaaaagccatttaaaattctgttgttctcagagaatggagaaagcaattgaagccatgggtgtggaggtgactgccctgagaagctgtgtatagtaaggagaactgggaagaaagaagacctggagaatagggtgatttgcacggcattaagtgaagcttgcaaaagtgagcactgagactcaagagacctgcatatgaatcaggaatggctgctcctgtgagttgttagaaaggagatgatgccttcttttcatatctataacagcagcacctagcacagtgcctgttcaataggtactcaacatgtattatcccaatgcagagtcaaattttgccaggagggcaggaaagccacaaattagctatggcaacttagtgattgggcttgtgtgtgtgtgtgtgagcgagctggatgtcaggcagtgggtaaagtagtgaactggaggtgagaaaacaatgacacaaactcagggcttctcttcccaagtatttggctgagaagagagatgtagtattaaagggagatatgtggtaaaggaagacttttattccaagattcaacaaaagcgtgagtatacttctatgttaaagggaaagagccaacagagaaaacacatttttgaggttagaagagaaggaagaactaatgcagaagggccccaaaaggcacaggtgcctgcaatctggatcagggacagattagctttggactcctacaaaagcaagaagggagaaaggaccatgtgactctagagatatttctggtaaaggaaaggtttaggaaaagatcttttgatgacctttattttaacagactttttttttctttttgagatggagtcttgctctgtcacccaggctggagtgcagtggcacgatctcggctcactgcaacctctgcctcctgggttcatgccattctcctgcctcagcctcctgattagctgggactacaggcacccgttaccatgtccagctaattttttgtatttttagtagagacggggtttcaacgtgttaggcaggatggtctccgtctcttgacttcgtgatctgcccgcctcggcctcccacagtctgggattacaggcgtgagccactgcacccggccagactttaaaaaaaaaaaaaaaaaaaaaaaaaactactgtgggaaaaaggatattatgtatagaaaagtctacacttcttgatacaactaactaaaaaaagcctgatacactaaacaaaacccaaataatgtcttccctaaaagtgggtaacttgaaaagcaatttgagcaaaaatcaaggagttcaattataaataagtatatcaacaaagtgaaagatgggtttaatttttcccacaaaaagttaaaagaaataacagcaggtttagaggaagaggaaaaaataataagaaaattatatgcagttgcaaaatgtgtgactatttacaaactctaacatataactacaaaatggaccagaagaatcattatcataggaagcaaagggtcatttcaaaaatcagaggagggatgattcatatttaatttaattctgtggaaaaaatttaagtaatgtttgaggacaaaaataggtgatgtgttgaaatgcgggaaaccacagtggaaggaaaaataattcaagaaagctcagtttcagtaaccagtatctagtaaaatcttcaggacctagaggctacaatctgcattaatagtgtctgaagacctagaaatgtcattaaataccattttggataattcttgtagacttgagatgatgtctatttaaagttacaaaatagtgcccatatttctgtattcattacagaaaacaattggatatggaaaagaaactaacatgctatgccacaatctctaaagaaagattagggaagtttcagcttaaagcaagaataatcacaataaagttttacaaccctttgcaagcatatatgaaaaacttacaaaaagtctgtaatgatcttttcttaagctaagagaacagaaaaaatgagaaaaattaaattataaaatgaaactttggtttagaggtaagaaacatttgatgacagtcaagagatcagggttgtacagtgtattatgtgaatgttgtgactcattggtttcatcttggatatcataacttgacattttgtaaaagtgatttttcatgggagtttcttcaggtgccctatgaagtcctgtccctttagaagcgaataatagtcttccacattcttgagatatcttaatgaataacatcttctacagtcttccattgtttagaccttggagagacacgcattagtgactgttaaggtacctgggttattaggtgcctgtagactatgcccagtgatatgtgcattaggtacatgctccctagctgtgctgacactgactgaagctgtgaggtttcacaatgacatgtcagccaaatacatatgctcagatttaccatttatcaagaggtcttcacactatcaattgtgcaattatcattctacacacaggcagcgataaagggagtaaaaaaacacagccatggatcgggagaccaaggtacctccagaggagtccagtgggtccagaagccctttggatgttggtcagaagctcctcttgggcagagatcacagcagcagccaacaggtctggagaagaccttacagttctcatggacaaagtttgtgaaggcatcttagacaagatcttgtctttgctggttttatgatcctctgcagatgggtctattctcattacctcagccacctttcacttcctatcagttcagttcaggtctctcatgatcccaggcagcagtagttgttatcacgtaagttcattcatatatgtttatctctggggatggggggacaacttcactgtggacttaattctactggagatgagtgaccccattttaagacaacaggatcacaaattattatcacatatcagcagggcagacaatagctacgacctggggctgaaagcaggtaactctatttattctgcaaaaattctgtcttgattatggtgccagttgctgtgagggatttcctttctagaacctgtttttcacaaggtttgagtctgaactgttaacattctactgatttctgggtgaagggactgactgcaccatcctagcctgtcagagcacttgccccaatacttccactttaagagttttccaccttgtccagaactacagtccactaatcccctcattttctctcttaagagaataaacaggccaggtgcggtggctcacgcctgtaatcccagcactttgggaggctgaggcgggtggatcatctgaggtcaggagttcgagaccaacttcgcctacgtagtaaaacctcgtctctactaaaaaaaaaatcacaaaaattagccgggcgtggtggcaggcacctgtaatcccagctactcgggaggctgaggcaggagaatcccttgaacctgggaggcagaggttgcagtgagccaagactgtgccacagaactccagcatgggcgacagagtgagactccctctcaaaaaaaaaaaaaaaaaaaaaaaaagagagaaaaagagagagacagagaataaacaacccatgtcaagtacacacccacatccctcttatcccaaataccaaacacacaaaaatccaatctgtctccttctacctaagcaattgcagatagtcacattcccataattaccttaagctccctgacttgctgctcgtcctttctctggcaaaatctcatccttggatgagcccgactttgtgtttgctcaatgacaccactcacctgaaccagaaaaaatatcaaaaagtggtcagagatatcatcataaattcaaattacttacataaaaaattggccctaaatgtttccagaaatcaataaaagttttgtttctccaaagacatcatttcttcagaaacccaacgtgtataacctattttttctatgttcttctaacattcattcaacttctctcatctgatatcttgccaaatcattcaaagagaaaatatatcccattagtcaagagccaaccatattcccatcacctgagaaaatcatatgcacaggatgcgcccacctcacctttctctgcctcatgtcagaaaaagtacccctccttttgtcacaaggcaaacctgagataaaagatttagatggcctgtaattccagcactaagggaggccaatgcatgcagattatttgagtctaaaaaagaagcctaagcaacttagggaaactgcatctctcaaacaaatacaaaccattagcctagcatggtggtgtggtggcacatgcctgtagtcccagctactcagggtggggagcactgaggtgggaggatcacctgagctggaaggttgtggctgcagtgagccgtgatcacgtcactgcactccagccagggtaacagatattttttaaaggatcttctctgttaaaaataatcaaataaacaggtggccatgaggctgaggtggctgcagtgcactcaattcctccttaaataacccaaaacttgactcagtgtaaataataaaaggaaacttaagtttaaccagtcagaaaccaccaactaacatctaactagagaccttccactgtaatgttccaaatgaggccactgctccacttcacccaatcaagtattttctttttcttccacattcaccatataaaattcttcccccaccctccctaagcctctctgtgggacctctgagctgcttgcagtctggggctgcctagtttatacatttctgaatgctcaaatatattttctaatgtttcaaagtggctctggtgtaggaggttgttggtggagtgacccgagagtatacaggaattgaggccatatgagatctctggaccctgtactccattttgctgtacactcaatactactctaaaataataatatatctttaaaaatctataactatcacgtagcccttttcaagtctccaactggttggagccagttcgattaaagctcagaaaaaactggttaataagctagttctgacccaactggcaagaagcggcaggaaagacccaggccaggggagcatattgcacatgcatgcaccaggaaactggaggaagcttggaggccctttagcctggtcctgagcccgctgaaactgcagttacaggcacagatgcctggggcaccaatctgaatctgccaacatccaaggccacatgaacacaaatgcacagtctcctctgcgatcggtagctaaggatgttaggccatgattggactaggatgggagatgaactgagaactctggattctgtaggttgttgttgtctcttcccacccccaagcaacaagtgatgaacacacacacacacacacacacacacacacacacacacacatcccgtagtgactaacaggatctccctccaggggatttgcaggaaggggagcagaaaacatcccaggggcctttcacagctacttccttgagccccctttcagacagtgctgtctagacctgtctcagcccaagcatcaccaccctgatacgcagaagctggcatccttacctgaaattcaacatcaagaaatgatctcttctactcaacactgatagaaatacctctaagcaacgtcctcattggcaggggtggagtgggggagtttcttaaaaagtgaggcctctgcctaccacctagagaacctggaaatttccatctgtgccacaaagtccaaatcactggccactgccccagtgtatggcagattagaacatctctccattggatctgggtttctattccattgagtgaaatgccttttctactacaggaacagaataagggatcaaaagggtcttacaactgaactccagtgtacagtctgcacagacactaggcttgtgcaaatatgacacagcgaggccccaggacccttaagccagctgaatgtactgagtttcaggaaacagtgagatacattcagcaaaacagtgggcttcatgctgaaagaagtcaatccaagtaaacacacatctcacacacacacacacacacacacacacacgcacgcacgcacgcagacaccctagtggccaataggtcctctcaccaaaaacctgcgatcaggagagcagaaagcctcccagggctccaccactgccctttctgtagccccttatcagacggccagcctcaggacagcactgtctgatcctggtccagcccaaaccgccatcaccctgtgatgtgggagcaggccacttcaccagaacctctgtggcagaaaaatttctttcttttaaaatgatgagggggaaccttcagacagtgtcctgattagggtgggtggagaggggggtttcccagaaagtcaggcagggcagggcagaagccctctgggttaactgtgtgcttttgatatgaaggcaggtaagactggacaggtgggggtgttagtgaggggatggtgtagggtgctgaagaactccacttgggctctgcgcaccagggaaaatgaccacaaaacatcccatcttcactgctcagagaaggctagatctgctgtgagctaggaagccatgtgggggcagctgatgagtcatcaaatgggagaaatctgagagccatgtgttccacaggcctctggtccttgttcaggcagcagggcactgtgagatgtggctccttggccctttccagccaccaccttgattgcctgctgcaaggaaagagactgaagcccaagaatggggtcttgctcaccataggatgatggctcagtgtgcagagctgagctatggcccaagaggcaaaaggtggggatgacccaggctgagctgggggatccaactgaacatgcacttgctaagaagctgtgggctatgatgccttgggaccccagtctgggtcgagaattgtagcaaaacaggctactggtaaaagttcttgggaagccaactcacttttgctttcatccgtgggcaaacaaacctctgatcaaccacaccacaatggtgtcactctgtaaggcacaggcagacaaggcatccagccttgcacactccagggcccacacatgtccagaatacaatggttcttgttgagactccactcttccaactcagacagaagctccccaatctcctcagccactcccaacaactggaggtctgaaaactttcatgcatgccgctatggtctaaaccactcgtggtggttttgattttcattttcctgataatcagtgatgctgagcacctttccatatgccttttcaccaactggatatcttctgtggctaaatgtctattgaaatccattgcccatttacaaatctgcttttttgtgggcttcttgatgtttttctttttttttttcctatttatttatacaagttccttagatattttggatatttttaaaaatgattttcaattccattgcccagttataaatcttttttttttttttttttttttttgagacagagttttgctgttgttgtccaggctagagtgcaatggtgcaatcttggttcacagcaacctccacctcccaaagtcaagcaattctcctgcctcagcctcctgagtagctgggattacaggcatgtgccaccatgcccggctaatttttgcatttttagtagaggcagggtttctccatgttggtcaggctggtcttgaactcccggtctcaggtgatctgtccaccttggcctcccaaagtgctgggattacaggcatgagccactgtgcccggccaattatccctttttgtggtttttttttggggggggtggggggaagaacagagtctcgctctgtcacccagtctggagtgcactggtgtgatctcggctcactgcagcctccgcctcccagattccagcaattctcctgactcagtttcccgggtagctaagattacgggcgcgcaacacatgcccagctaatttttgtatttttagtagagacggggtttcaccatgttggccaggctggtctcaaactcctgacctcaggtgatccacccacctcccaaagtgttgggattacaggcgggagccaccactcccggccccattttgtgttttaacatcagtcgacactcgtattttaaaataataacaatgaatggcggtaccttagaacaaggtaattatacatctttctcttgtcctagtgcagacattttgtctataaaatgttattcacagatgaattcatgaaaacattactgtgaattttaaatccatatacaagtgtatgcttgttcatgaatacttcaataaaataaaactaatagcaaaaaagaattccagagttgaagcagtttcaggaaaaaggagttggcagtatgaagtaaaatagaaaaaaatgggtttttttttaaatgggtatatttgtgtctacaacttttttttaattatagcattagacaatgtgtatatatatatacatatataaagcaatggaagtggcattgttttcatactagtctaggatattaaaatatatgtaatatgtgattggcaaaataatggccccccaaagatgtccacagattcctagaaccttacatgaaaacggtacatcatgcatgtgattcaggtaaagaccttgacatgaggagactaccctggtgctatggaatgaacgttgtgttccgtcaatgttcatgtgttaaaatcctaaccctcaaggtgatggtattaggaggttaagccttacgggagactctgccctcatgactgggattagcaccttattacaggcacaagggagcttgtttgttcctctcaccatgcgaagacacagcaagaaggaagcctctatgagaaagcaggccttcaccagacaccaagactgccggcaccttgatcttgcatttctcagcctccaggactgtgagaaacgaagttctgttatttataagctacctggtctaatgcatttccttgtagcagcctgtatggattaggacagtgggctcatgtggatgatgacggtgtgtccattcaggactaagtaagcacatgagtccttaacagtggaagagaagggggaaggaaagagccacagagacatgtggccacagaagaagggtccatgggatgcaaggttgctaatggtgagagtggagaagagcccaaagccaaaaaatgcaggcagactccagaatgtggaaaaggcgagaaaaaagatcccctagagcctctagagatgaaggtagcctttccaccacctagattttagcccagtgagatccacatcatactctgacatacaggagtgtaataaatttgttttatgccctgacatagtggtagtttgttgtagcagcaatggactagtaatatataaatatatatatacacacacacacacaaacactacccccccaccacacacacacacacacacacacacacacacacacacacacacacataactatatatatcctacccttcaaaattgaagcagataaactacacattagcattaacttagctgggtgtagtggatcatgcctgtagtcccagctactcaggaggctgagagggaggatcatgtgagcccaggagtttaagatcagcctgggcaaacacactgaggccacatttcaaaaacaaacaaacaaacaaaacacaacaaatctttgattaagctcatttcccaaatttgaagaggagacaattattagataaagaggagaaaagagaaaggtagagctgctgacttttgtggcggaagcagaggcacaggcccaaacatactcctttcctcctggctttcctgtcccttctcataagggacacatgaacctctcaaactgaaccatggatcacagacccatactcagaactcaatacagttttgttctatgattttttacatgtctgtgtccttgcttctgcctcccattcccaactcccttactctagttagaaaaaaatggctattaccaaatatgagtacatcctcatatactaatgccaactgatcatcacctggttttcttcttttacaaagtcataaatctttagactttaacacatcttccaagcaatagaatgttattttccagtccattaacacaaattctatatttaaaatgaagacttcacaagttgatttaaataacatattaaccaacatagactggccatggttcaaactgacattttaattaaatgtgatgataggttgagtaacctagcagtactctaaaatgacttttggttatggctttttccatattatgtttaggctgaggcatccctaaatgattcaactgtaattcctcttcttaaacatgagatttatctttacaaaataatttattttcttaaaattacaagttaattctatagttcatgcatacataatctcagcagatatcagctgtatgtgtacacacatacatataggtatttgtatatacacacattacataatttttttaaaaacttattagtagggtagaaccacgaagacaaagaggctttgtgtaatgtgatggaaacacatttgcaggacgaacaacaggctgctgtgagggctgcatttaccctttctactgtaagacttggaaaaacatggatagtggatatttaatccgcataacagaaatttcagggtgcagaaaacttcccacaatttttacagacaatgtcaacagacaggcattcaatgcagggaatacacagtgtgacagtatacaaaaataagcaggttgatggtttagatttatgagacaagagaaagaaatagatgatgccataattctccttttatggagttatgaaaattgttcattttatataaggtcaggtgctttcaaatgtcaatgagaaaaatatttaaaggaagaatcaaatctaagacgtggagagatctttataaaaatgaccttcaggccaggcacggtggctcacacctgtaatcccaacactttgggaggccaaggtgggtggatcacaaggtcgggggatcgagaccatcctggccaacatggtaaaaccccgtctctactaaaacacaaaaaattagccgggagtggtggtgtgtgcctgtagtcccagctacttgggaggctgaggcaggagaactgcttgaacccgggaggcagaggttgcagtgagctgagagcaccactgcactccagcctggcaacagagcaagactccatctcaaaaaaaaaagaaaagaaaaaaaattaccttcattctgagaaggtataatcatcaacacattcttgagcaaaactacgcacatacacacttccaaattcacaaaccatgcttgtgcacacactgatgtctctagattccttttttgaagagatggcaacttggtgtgtcacccaggctggagagcagtgttaggatcatagctcactgcagcctcaaactactggggtcacgtgatcctcctacatcaggctcctcagtagcctgaactataggaatgagccactatgcccagccaatgttttcatttttttgtagagatgaaatcttgctatattgcccaggctggtcttgaactcctggccccaaggaatcctcctgccttgccctccaaacgtgctgagattacaggtgtgaaccattgtgcccagcaactgtattctttattaagaagaaaatttgtttgctgacatgtaggcaatgaattgataagtaatagttcagaaattactaatttacaagtcaatataaatgaggtgagtaaacacaaaaataacagcataaataaacagttcatgacttcacgtttctttttctcctttaaaatgtagctctgacagagactactacttgtccattccatggaaaagtcagaggtggttaaaatgtcagaggtacacttactaatactttgatgccttttgtgtagcttcttctcagtacttcaccagctgggattgacacacctctacaggtgggttcaggagccagacagcagcacacagaatggggaatccaaagccatctctgacactaaaagcaatgaaaacaaaaataaccaaacatattatcaagaaatgaacaagagattgatatcaagtaaagcaagaagagaagaaagcatttaatctgccaggctttcattctgacaaaataatttacaacatgcatgtctctatctgacatgagtgaatagaaaaagaacccaaatacccagttgaattgcaagatgaaaatgaaaaagaactcttgcttattcgccagggtacaatctaatctgggctactaaaacactttcatgcactgattctatgtaacacatgctttattgccatttggaaatgggatttcttgctttgatttaaatatacttccttggatttctgctttaagtatactttcttaaacatattcacagctacattctcagtacaaattttcaggtgtaagtaactacttctgcttttgatagtataattggtgaaataagctatacttccatgtaaatgtgagagtacaaggtaagattccagagtcaagtaaaacataacagtcaagaaaataaaaaggtgagagtaactgggcagtggggaaatcttgtgtgtggaaagaatgaatctgtaaaactgttctttcctaagagagttcagcaggatttggatgatagagagctttgtgtacaagggttccagttccacatagtttaggtctaatttcaaaggcaacttctagtgcaacctgtgactcacgctgtcctaaagtgccaaatgtaaagggtctggagataacccacaagcagcactgtgaacccctgacagcaagcctttccagataaatacctgtcagtgtctatagctgatgacagagcagaatatctgaaaaataatacttcttcggccaatggactgccagtcactattatttagtgtaaaatactatattacatatgtgtaattttttaaattgcagtgtttcacatcgaagcaactaaatataaaaaccaaatgtttattcagcttaaaggcaacttagaaatactgatcccagatagaaagatgctttagtcccaagtcagctgttctaaaatgccacaactaaaccaacgaagggatcttgaagcatagtaagtgttcataccttttcagctatacctctgcttgtcttgaatataaaaacctaagctgcagttatgccacagcacagaatgtgttatattttacatcactgagccttagttttacaaatggtaaaaaaatagggaaggtaaactgaggttttcttaaggagctgttacatccaagagactcgtgaaaatctttgccaaatgtccccggtacatagctcctccccactgatgggctcaacggggagaagctatgcacatgtctcaatctgcatatgctcaatggcaatacaggattcctaggataaagtaagggatataaatgacacagcacactgaaaagactgtaatgttacttcagaatgttgcaaaataaagattacagatgaaagttttagttcactgaagcatgtagtcatgtatatttcatttgtgtgttttaaagtcttatactgcttacattctctttttttgtttgttttaaaataattatatttggctacaaagatcaataacaaggatgatgtcagtccaggttggacaggcagttctggggcagatgttcttgcagtatttttttttttttttttttttttttagtatttattgatcattcttgggtgtttcttggagaaggggatttggcagggtcataggacaatagtggagggaaggtcagcagataaacatgtgaacaagggtctctggttttcctaggcagaggaccctgcggccttccgcagtttttgtgtccctgggtacttgagattagggagcggtgatgactctcaaggagcaggctgccttcaagcatctgtttaacaaagcacatcttgcacgctcttaatccatttaaccctgagtggacacagcacatgtttcagagagcaccgggttgggggtaaggtcatagatcaacagcatcccaaggcagaagaatttttcttagtacagaaagaaatggagtctcctatgtctacttccctccacacagacacagcaacaatccgatttctctatcttttccccacatttcccccttttctattcaacaaaaccgccatcgtcatcatggcccattctcaatgagctgttgggtacacctcccagacggggtggcggccgggcagaggggctcctcacttcccagaaggggtggctgggcagaggcgccccccaccgcccagacggggcggcagccgggcggaggcgccccccacctccctcccggacggggtggctggcggggcaggggctgccccccacctccctcccggacggggcagctggccaggcgggggctgcccccccacctcccggacggggcggctgtcttgcggagacgctcctcacttcctggacggggcggctgccgggcggaggggctcctcacttctcagagggggcagctgctgggcggcggggctcctcacttctcagacagggcagctgccgggcggaggggctcctcacttctcaagacacggcggctgggcagagacgctcctcacctcccagacggggtcgcggccaggcagaggcgctcctcacatcccagacggggcggcggggcagaggtgctcccctcacctcagacgatgggtggccgggccaagacgctcctcacttcctagacgggatggcagccgggaaaaggcgctcctcacttcccagactgggcagcccgggcagaggggctcctcacatcccagacgatgggcggccaggcagagacgctcctcacttcccagacggggtggcagccgggcagaggctgcaatctcggcactttgggaggccaaggcaggcggctgggaggtggaggttgtagctagccgagatcacgccactgcactccagcctgggcaacattgagcactgagtgaacgagactccatctgcaatcccggcacctcgggaggccgaggctggcagatcactcgcggttaggagctggagaccagcccggccaacacggcgaaaccccgtctccaccaaaaaaatacaaaaaccagtcaggcgtggcggcgcgcacctgcaatcgcaggcactcggcaggctgaggcaggagaatcaggcagggagggtgcagtgagccgagatggcagcagtacagtccagcttcggctcggcatcagagggagaccatggaaagagagggagagggagaccgtggggagagggagagggagaccgtggggagagggagagtgagagggagagccagaatttcctttttacaggcagaataatattctatgtatataccacatttttctttttttgagacagggtcacctaggctggagtgcagtggcatgatcacggctcactgcagccttgacctccccaagctcaagtgatcttcccacctcagcctcgggagtagcatgtaccaccatgcttagctcattttttgtatttttagtagctatgttgtccaggctagtctccaactcctgggctcaagcaatctgcccatttgcctgcattggcctcttagaatctatctttttttttttttttttttctcactctgtcgcccaggctagagtgcagtggcacaatgaaggcacactgcagctttgacctcctgggctcaggtgattctcccatctcagccttcccagtaagtgggactacaggtgcccaccaccaagactggctaattttttgtatagacagggtttcaccatattgcccttacactcctggactcaatctgcccacactggcttcccaaagtgctgggattatagacatgagctaccacacccagcctgtatggctgttgtgaataatatgctgttatgaacatgggcacactaaacaccattcaacttaaaaaaataatcaaagccttaagaactgaaccaaaatggcttaggtgaaaataaaataccaaactctgctctaagaaaaggaaagagcattcactgaattataccttcagcaataagcacttaatggaacttgtttcatttaaaatgcaccacaatcctgtaaattgataatcataccgcaattttatagatgagcaaggtattaggcggacctttttcaaaaggtcatacagctagtgacaaatatttccaaatttttcataacatttctttttttgagacggagtcttgctctgtggcccaggctggagtgcagtggtgcaatctcggctcactgcaagccttgcctcccaggttcacgccattctcctgtctcagcctccctagtagctgggactacaggcacccaccaccatgcccggataatgtttttgtattttcagtagagacggggtttcactgtgttagccaggatggtctcaatctcctgacattgtgatcctcccgccttggcctcccaaagtgctgggattacagacgtgagccactgtgccaggcctaacatttctgttttaaatagcttaattaactacacatgttctatattcttgcctctgaaaggcagctttttttgttgggttggtttattatgcatcagacacttgatttgctgaggaattctgtttttcagtaattcatccaccacaaatatcacgtagcattttgactccacagacctaagagtcttaagtcttaaaaggattgtaaaatctaagtttttctgagatatctgagagtaagaggcttttttctattgaaaataggttgcatttcaaactttatctgtaagagctcacaacactttctccaacatgcatgcccatgtgatcacttaaacagaactctgagtgagacagtaaatacctcatatgcccttgaaaattttaccttggcatagaaaaaccttgttaagaacctaaaaataatttcactttgaaagtctttagggttagacaaatgttaaacttcaattggcagtacaagggcagcactcaagccagcaagagttttgttgggccaaattatgttgaaaaagatcaaatattttaaaaacaggagatttcacataaaaatctgggattccagcttcttctgaataaatgaggtacactaattatgcagagtggcaaatggctggagttgagtgggaggtgtttctagcccaacagataggcatggaagctccagctcagccccctccactccattttcttacacaagggaagccactatggtatagcatctaacttaaggcatattatatgtattcttaagacagaggaaaaggctgaatatttgatattgtcaaaagaaatgagagtctaactttctgtggcaaggaccttcttgcagtagtcacataacatagtctggaacacctccaacataaattatgaaaagaaagctcttggctcagaagagaaaaagcaaaaaagaatactcattaattctatgtcacaggacaaatagatttcaatttccattgcaattgtagaagaggtaaataatctgctgacccagaattccaacagggactcacacttcctgtcttaataactcgaaacactgaaatcactctaacaaaggcaaatcaatgtcttattaatttctggttaaaaaatagacccaagaagacagggcacagacataaattttgtgtggtgggaatacgaatataacttcaacgtccagattcatggatttggaaatgaccttgggcactctaagtatagcaccactgaagtttacatttagggaatggctaatccctgctgatctaaactatttccaatccccaatgtactctttaaatacagaaatttaaaaaaagagggggccgggcgcggtggttcacacctgtaatcccaatacttgggaggccaaggcagggtggatcgcttgagctcaggagtttgagactagcctgggcaccatggtgaaaccccgtctctacaaaaaacacaaaaaaattagccaggcatggtggcgtgtgcctgtagtcctagcatcttgggaggctgagatgggagcatcacttgaacccaggaagcagaggtggcagtgagccatgatcacaccactgtactctagtctgagaccctgtcaaaaaaaaaggaagggctcaacatagtaggtacagagctattttaatagaaagatcatgagggaaaaactagcagctgtcagatagagagtaatttattttattcatttatttatttttatttttatttttttgagacagagtttcgctcagctgcccaggctggagtgcagtggcgcgatcttgcctcatggcaaccaccatctcctgggttcaagcgattctcctctctcagcctcccaagtagctgggattacaggcacccgctatcatgcccagctagtttttgtattttagtagagatggggtttcatcatgttggccaggctggtcttgaactcctgacctcaggtgatccacctgcctcggcctcccaaagtgctaggattacaggtgtgagccaccacacccagcatttcatatttcatttctttcatttcaagatggaaactcactctatcaccccggctggagtatgccactgcacctgacatttcattattcatttcatttcattatttcatttcttcatttcattgcacccagcatttcattattcatttcattatttcatttcttcatttagtttcatttcatttcgagatggaaactcgctcaatcgcccaggctggagtgcaccaccacacccggcatttcattattcatttacttcatttcatttcgagacaagagacttgctctattgcccaagctggagtgcgccaccgcacctggcatttcattattcatttcatcatttcattttatttcatttagagatgaagactcactctaccgcgcaagctggagtgcaccaccacacccagcatttcattattcatttcattatttcatttcatcatgtcatgtcatgtcatgtcatgccatgtcatttcatttcgagacagagactcgctctatcacccaggctggagtgcgccactgcatctggcatttcattattcatttatttcatttcatttcacccagcatttcattattcatttcatcatttcatttcatttcgtttcatttccagatgaagacttgctctattgcccaggctggagtgcgccaccgcacccggcatttcattattccattttatcatttagtttcatttatttcatttcatatttcatctcatttcatttcatttcgatggagactcgctccattacccaggctggagtgcgccaccacacccagcatttcattattcatttcatttcacccggcatttcgtatttcatttcatcatttcatttctcacttcatttcatttcatttgtttcatttcatttcgagacagagactcgctctatcgcccagtctggagtgcgccaccacacccagcatttcattattcatttcatttcacccggcatttcgtatttcatttcatcatttcatttctcacttcatttcatttcatttgtttcatttcatttcgagacagagactcgctctatcgcccagtctggagtgcaccaccacacccggcatttcattattatttcattttttcatttcatctatttcatttcatttttcaatttcatgacgtagactcgctctaacacccaggctggagtgcacccagcatttcattattcatttcatatttcatttcccatttcatttcatgacagagactcactctatcacccaggctggagtgcgccacccacatttcattattaatttcattatttcatttcatcatgtcatgtcatttcattctgagatggagactcgttctattgcccaggctggagtgcagtggtgtgatctctgctccccgcaacctctacctcctgggtacaagcgattctcctctctcagcctcccgagtagctgggattacaggcacccgctataatgcccggctactttttgtattttagtagagacagggtttcaccatgttggccaggctgatcttgaactcctgacctcaagtgatccgcccacctaggcctcccaaagtgctaggattacaagcgtgagccactgcacccagcatttcatattccatttcatatttatttcatcatttcatctccttcatttcatttcaaaacggagtctcactctatcacccaggctggagtgcatcaccacacccagcatttcattattcatttcatttcattatttcttcatttcatttcatttcacctggcatttcattattcattatttcatttcttcatttcatttcatcccatttgagatagagactcgctctatcacccaggctggagtgtgccactgcacctggcatttcattattcattgcattatttcatcatttcatttatttcattttttcatttcatttcatttcacccggcatttcattattcatttcattatttcatttcatcatttcatttcatttcattttgagacggagactccctctattgcccaggctggagtgcgccactgcacccagaatttcattattcatttcattatttcatttcatcatttcatttgatcatttcatttcatttcaagacagagactcgctctatcacccaggctggactgcgccaccacacctggcatttcattattcatttcacccagcatttcatatttcatctcatcatttctcatttcatttatttcatttcatttcaagacggagacgcgctctatcacccaggctggagtgcgccaccacacctggcatttcatatttcttcatttcatttattccattcccatattcccattcccattcaatttcaatccatttcatgacagagacttgctgcattgcccaggctggagtgcaccacacgcatttcattattcatttcattatttcatttcaccatgtcatgtcatgtcatgtcatgtcatttcgagccagaggcttgttctaacacccaggctggagtgcagtggcgcaatccctgctcactgcaacctctgcctcctgggttcaagcgattctcctctctcagcctcccaagtagctgggattacaggcacccgctatcatgcctggctagtttttgtattttagtagagatggggtttcatcatgttggccaggctggtcttgaactcctgacctcaggtgatccaccgtcctcagcctcccaaagtgctaggattacaggcgtgagccaccgcacccagtatttcgtatttcatttcatttcatatttaattttgtttcattatttcatcatttcatttcaagacggagtctcactctatcactcaagctggagtgcatcaccgcacccagaattttattattcatttcaatatttcatttatttcttcatttcatttcatttcatttcacccggcatttcattgttcattatttcatttcatcccatttcatctcatgtcatctcatttcatttcgagacggagacttgctctattgcccaggctggagtgcaccactgcacctggcatttcattattcatttcatcatttcatttcatttcacctggcaattcattattcattttattatttcatttcatttatttcatttattctcttcatttcattccatttcatttcgagacagagacttgctctattgcccaggctggagtgtgccaccacacccggcatttcattattcatttcatcatgttatgtcatgtcacgtcatttcattctgagacagactcgctctatcgcccaggctggaattcagtggcgcgatctctgctcactgcaacctgaggtcgggagttcgagatcagcctgaccaacatggagaaaccccgtctctactaaaaatacacaaaattagccgggcatcgtggtgcatgcctgtaattccagctactggggaggctgaggcaggagaatcgcttgaactcaggaggcagaggttgctgtgagccaagatcatgccattgtactccagtctggccaacgagagtgaaactctgtctcaaaaaaaaaaaaaaagtgatggtagatgctcacactggcaaacgttagcaagtactagaagggtcatttggcagtagtcattcacgttttaagcatgcagataatttgctcaaataacttaatttttagcaatttatcctacaactaaaatgtatgtgcaaaactgtatgtacgacagtgtttaagagaaggcctcaaagaaaaggtggtatctgaacaaagatggacagatgatgcagcatttgaggtaggtatctggaaggattgttctaggaaatggtaacagcaagaataaaggccctgaagtgggagttaaaagacaatgggaataggagtagaatctggagtcatcaaagtggcaagggagcaaattacagagaagatagagccactttaaagaatctggcttggcccggcctggtggttcacgcctgtaatcccagcactttgggaggctgaggtgggcagatcatgaggtcaggggatcgagaacatcctggccaacatggtgaaaccccgactctactaaaaatacaaaaattagctgggcgtggtggcgggcatctgtaatcccagctacttgggaagctgaggcaggagaatcgcttgaacccaggaggtggaggttgcagtgagccaagattgtgccactgcactgcagcctggcgacagagcaaaactccgtttaaaaaaaaaaaaaaaaaaaagcaaaaaaaaaagcttaattggattttgattgctaccttctaaatatcagcactttcatttaatcataagcctcaaagggtttataaaacttctaaagagttaagtttcataattctcctaacgagagtctacacatactgagatgttaatgcagggtttagaaactgtcaaaaactttcataagaccctcaaagagatctaggacaattcctcccacccacagaaaagcaatcacccaaacaactgagaatcagtggcaaaaaaactctcctaaaaggacacagtactatggggagtcaaaaacaattcagacagctgggcacagtggctcatgcctgtaatccagtaactcaggaggctgaggtgggaggattgcttgaggccagcctgggtaacatagcaagaccccattgctaaacaaaaaaagaaacaatgaaaaaaattagctgggtgtggtggcatgcacctgtagtctgaaccactgggcaggctgaggtgagaggatcctttgagcccaggagttcaaggctgtagtgagccatgatggcaccattgcactttagcctgggtgacagagcaagaccccaactcaaaaaaaaaaaaaaaaaaaaacaagggaaacattttagtgagtttagtcttgcctggaagagacaagtaagggacagatgggggcagtggtgagggagcccaggacagctagctgctatgctattcaaagtcacatatattgcttccacaatataacaaaacagagaaagaaaccaccaaacagcaaaccgtcttctagtgatcccatcatttttttttctttttttttttttttttttttttgagacagagtttcactcttattgcccaggctagagtgcagtggcgtgatcttgcctcaccgcaacctccacctcccaggttcaagcaattctcctgcctcagcctcccgagtagctgggatttcaggcatgtgccaccacacctggctaattttgtatttttagtggagaccggatttctctatgttggtcaggctggtctcgaactcctgacctcaggggatccacccgcctcagcctcccaaaaatgctgggattacaggcgtgagccaccgtgcccagctgacccaatcatctttcacttcaaccttttcctcaccatctcttcaactaatacttttcctggaccattttgactttaggcttctacctccaatctattttatctacccactacttctaacttaatcttcctcagagataattctaatactctgtccaaaaacctttgatgacatgctgcctttctatgtaattttaagcttcttaccttagctttccatgccataagcctaaactatcttcccagacttttctcccacaccttccttatatgtatcgtataatcaaacagatacatcagaaaattcagtccatccttaaggtctggctcaactgttatttattacttctttcccttttctagaaattttcctgatttctctgtcctggaggtaatttggtttggtgagaaagacaacgggctttggactcagactagagtttgatgcactagaacatgacagagctgtgtgagcatgtggaggtaatttaacttgtctgaattttagtttctttgtctataaaacaagggagtaccagtctactaccttcagagaatggtaaatgagctgacctatataaaggatgtgacctcctttctactttaagcgtattttgtacaatttttagcggagttaacacagctttcctcttggaagtcaacagacaatatgtaagactgaaaagtcaagaaaaatcaagataataatattatttaaaaacatgaaaataaaaaataatgaattaaagcagcctaggcatggtagctcacatctgcaatcctagcactttgggaggctgaggcaggatgactgcttgagcccaggagttcaagaccagcctgggcaacatagtgagaccccatctccaaaaaagaaaaaaaaaaaaataattagctgggtgtggaggcgtgtgcctgtagtcccagctactcaggaggctgagatggatcacctgagcccaggaggtcaaggctacagtgagccttgattgtgccactgcactccagcctggatgacagagtgagactctgtcttaaaaaaaaaattaaaataagctgggagtggtggctcacgcctgtaatcctagcacttgggaggctgaggagggtggatcacctgaggtcaggagtttgagaccagcctgaccaatatggtgaaaccccgtctctactaaaaatacaagattatttttagtacaagatcttcttaggattatttcctggacagtatatagtgatgttacaaccccagtgatttaaagcagatctctcaaagcaaaggaggaatgagcttttgtcaggatgctagtggcatgtccttagtattagaggaaaacaaagaactagattccttttgtttgcccccaaatcctttaacctctgagacttactataaatgatttacctgtttacactatgtcattgtgttctctctgggtaaggctcttaaggccttccacccaactgaatcaggcccacccagattatcgcttacttaatgcaaattgtattgaatgtggctaagcacagtggctcatgcctgtaatcccagcactttgggaggccgaggtggggagatcactcgaggtcagtagttcgagaccagcctagccaacatggtgaaaccctgtccctactaaaaatacaaaaattagctgaacatggtggcaggcacctataatcccagctacttgggaggcagaggcaggggcatcacttgaacccaggaggcagaggttgcagtgagccaaggtcacatcactgcactccagcctgggcaacagagtgaggctttgtctcaaaggaaaaaaaaatgcttattgaatgcaataagattaactcctttacttgtagactttgatcacatctataaaatactttcacagcaatacccgaattagtgtttgacagaataactgggggctgtagcctagctaagttgacattaaaaaaaaaaaaagactatcacaaaactaaaggtggaaacaatccaactattgataaaaaattaacaaaacatttgccacgatcacacaaaggaatactccttagtaataaaagggatagaaccactgacacattaaaaaacatagatagatctcacattacgctaagcaaaagcagcaagatacagaagtgtgtatgacatatatttacatgacattctaaaaaaaagaaaaaagtaatttataatgaaaagaataaaaattatggttgtttctggggttggggactgaccagaaaagggctcaagggaattttctgaggtgatagacatggtttttttttatgtcttgataggggtgtgggatataaaagcatatcaatttgccaaaactcaccatattatccacttaacattgtatacttcaatgtgtgtaaattttacttcaaaaataaaagaactgtaaacaagtaatgaactctatttaacaggtttactttttgcagtggcatggtttagaagttctgaaatcaccttttgtatatattaggcttaaacaaatgagaaaaattgaagatattgggaaccacattcttcattgttggagaagagagttccaattatggaaagggggaaagactataatataggctgtgatgctggttaagaatgggaggtatcaatataaattcacagttgtatatgtgtgtgtgtgtgtgtgtgtgtgtgtgtgtgtaacatatatgttctagttcaaatcttggcttccaaaactaactaaaatccaggaccacctgcagaaatggctgattccagagctggtgcagggaatatacaagatgagcctacaacatctttttgtgctaaaaagatggagatgctcaaagaagaaagtgcattaaagaatgatgggcacatgtcaaaggcacacaatagttaacttgaaggcattcccactgatggaatatgggacaatttagcaccaaacagaaaatagcaatggatcataatccactgaatacaataagaatgcaagtgtctatacttgcatatatattaataaataataaatattaataaataagtatacacaaataaggaaaaagggaaaattcttccttatagtagaatgccaactactaaatgtagaaagaatgggagtttaaaaaattagcaatgactgctaaaattagtaggtgaaggttttatgaggacaagatgtttacagtttcaaagtatataaaatatatagcgatacattaattacagaatgaaaaagtataacctgacagtggaggaacctggtcaacccaacttaaccaagtcattacactggtgtcacaaatattgggacaaagtgctatcacatgtctcctcaaaagatatactaaatagaacacagtatcacttcagtgggattcctaccgaaatgaataacctgaacctaattaggaagaagcagtgggcaaacacaagaaggacaatctacaaaataactagcctatccactttagaaatatcaaagtgaacaaacacaaggaaaagctgagaaatggttccagtttaaagaataccaaggtatgagcctggactaattgaagactggaaagaaagctacaaaggtcataattggaataacaaaattatattataatatagattaactaacagtactgtatcaaattaaatttcctgattttgataactaactgtgctgtgctgatgtaagacaatgtcctagttcttaggaaatatacaacaaagtatttagggataaaagggcacagtatctccaacatattcctaaacaattcaagaaaagaaaatagagaaaatgatgaagtagatgggacaaaaatgtaaactggtgaatctgagtaaagagtatatggaaattccatgtattattcttacaacttttctgtgaatctgagtaaagagtatatggaaattccatgtattatacctgcaacttttctgtaagtctgaaatttcatatacatacacataaaaacacgtaatataaggccgggcggggtggctcatgcctgtaatcccagcgctttgggaggtcgaggcgggcggatcacaaggtcaagagatcgagaccatcgtggccaacgtggtgaaaccccatctctactaaaaatacaaaaattagctgggcgtggtggcgtgcacctgtagtcccagctactcaggagaggctgaggcaggggactcacttgaacctggagggtggaggttgcagtaagctgagattgcgccactgcactccagcctggtgacagagtgagactctgtctcaaaacaaacagaaaaacacacaataaaaaccacataatataaataaagctatgaaaatactctattttcatatatgattaaaaatttccagaatcaaaagttccaagatttaaactcaatactagagtttccagtctattatttaatatactacttctaaaaataatttgtattttaattattagacatttatctagaattttggacaagatattcatgctaaaaatcaagaaaataactagaaaatttatgttatttcttttatgaagcattccttgacaccataagtagggttgattgttcttcctccatgctcccaaggtattttgcacataacattggtagagcacttagcatattgaattgtaatctgaaaatcaattgcatttccacatagtagcaatgaataattaaaaacagaaattttaaaaacttacaacagcaacaaaattatgaaatacggataaatctgacaaaatggggaagaattatacaatgaaaaccataaaatactaatataaaatactagtgagtaaaactgacatgaataaacagagacatacatcctagacatgtgtcaaagacaaaacattgttaagatgtcaattccgaggtgggcggatcacctgaggtcgggagttcgcgagcagcctgaccaacatggagaaaccccgtctctactaaaaatacaaaattagccgggcatggtggcacatgcctgtaatcccagctacaagggaggctgaggcaggagaatcgcttgaacctgggaggcagaggttgcggtaagctgagatcacgccattgcactccatcctgggcaacaagagcgaaactccgtctcaaaaaaaaagtcaattctccccaaacagatctacagattcaaagcattctcaaaattcagcaagctgttttggtaaacattgaaatactgattctaaaacttggcaaaatgactctgaaggagaaaaaagttgaaggacccatactacctgattttaagacttattataaagctatagcaaccaaaacaggaagaaagaaaacaacacattaataagcttacttcaaaacttaaaacttctgtgcttcaaaagtcactgtgaagagaatgaaaagacatgctagaaatatctgataaaggatttatatccaaaatatataaagctttcaaaactcaattaaaacaaaaaacaatgaaaacttaaacaaaacatagcttcatgggtgtagtcatacgtccaaacttacataattgtataaacaaatagtttattttatgtcaattatacctcaataaatctgtcttaagaaatggaatctgactccctcactagactctcagctcctcaagggcagggattataaattataggcggggtgtgttggctcatgcctgtaagcccagcactttgagaggccgaggcaggaggactgcctgagcccaggagtttgagaccagcctgggcaacagaatgagaccttgtctccactgaaaattaaaaaaaaaagttaggtgggtgcagtggtgtgagcctgcagttcctgctactcaggagtttgaggtgggaggatcccttgagctcaggaatttggggtaacggtgagctaggattgtgccactgtaccctagcctgggtgacagagatcctgtgtctaaaaaaagaaaaaataaataatatttttatctacattagcatcttgtaatgcaagaatataaaagcagttgagtaagaacttgccgaataaacataataattaatgagccaaagaaatttaactgatgattaaaacaatgagtccagaaataatccgaaggcactacataactgacgcatactaaaaattcacatctacaataaatgcatggtatggtaaaaagagcactgcactgagattaggaaacgtgagaaactcaaagtggatcttcactagctaggtgaccttagataaccaaacctcactggacatcattccatcatctgaaattcagggttcttaataattcttattttgtttacatcatagaattccttgggaaactaaataagacaagtaaaaaattcattcaaacccacaaagccatcagtattggtgtcattagaaataaattttttaagggggtagagaaaccacagatacgtgattctatttactcgagggtgaaaagcaacctggtctacttgcctgataggaaccaagacagcaaggactactccttcttttctgttttctgcctagcggtagacaagcctcgtttttcctgttcataaaaagacaaactgcctattctgatctgttaactcggaaaacaaatacttgttctgtctttttaaaagaaagtggctgaaaaatataacatatcaattatcatgtttctacttcatgttaatatagtttcagtgttcttctctgagaggaacaaggttagatttacttccttccctccttcatgggaaataaaaaatacacatacaaacacttttgtactaaacaagttaaaccctgggttttctaagtagacaccttttaacatgccaactgtctccttcgaaaaaagtgaatgcccttaacttgtttaaaatttaaattaatgaactatgatgaaaatataaaggtaaactggtaacagctactgagacagaagactgaatgacctttgtgatagctctcactagggatgggcctttaagacttcatagtcaaagaccttcacttaaggaaaaaactagaaggaatccattaaaatcttatgaggaattcatgacctcttcatgattttttagatttagtagtaagaaacatggttattttcccttattaggaataagagtttgtaacgatcatgggaaaaaacattcggagattaaaaaaaattctacttaccaatggattgttcccttggaaagcaggtttatataaacaccattttacccaaattttattagcatcactcaaacagtagtgattatgcagtaaatagaaaactcttgcttttaattctaatgattattaaaaacttagaaaagacaagcataaaaacgtttaatttccaaacatttttggaaaactccaactgaatttggacctttcccaatgagctggtgtcttgacaggcacctctagtactttaactctagaagatgtcaccagtactataagcaatggtgtctacttgttatcatttctatcagctctgctgacatttggaaaagatgtaaagatttgtgatgtctgggataatctgattcactagaggcaggttttacgttaaatacaggaatactctgcccagtaggtttcatgtctaggcacctggtttatgtgctcaccaaacagaagcagaaaaacaactctcagaaaacttaacaccctttagtattgaaactattttctggatgttgtacagaaacaagtaagagaagacaaaaaaaaaagaagaaatgggaagattggaattttaactctttccctctatctatacttactgaaaggtttttaactcatggctgccccaggcaggatcacaacaaacagagggataacactgtctgtataaaagtatttgcctgtttgcatgacctgtttcatattcttttaaaataatgataccaaccagatgtcccacaatgatgataaatttaatttatttccaatttctcaaactcttctacagattcaggcagcacagtcacagccattagctcactgagctggatgcatcattgaaggaacagaattgatcaggcagatagattgcagtgcatggctaagagtctcctaaggagggagatggcagaaatccagacatcaaatagatgatgaaatggccatttccattaaggtaacatcacatcacagatattaattaggaggcactataataaagttaagtggatgtggggggaaaatgctgagttaaaagtcaccccatatgtccttagcctgaggtaattacagatctgaaggtgagtcatggatctgcaattttccattcattttacaatagctgcaggaacgtttagagattacgtaaaaggagattagaatccttttttagactggggacaaattatctttaaaaaaagaaaatattcttatgttttccttttaacattcctgttttattcccaaggaaaatgacatcctttatttacattaacattaatggaggatgacaatgtactgactactttcttcttcttcttcttcttttcttttttttgagacggagtctcactctgtcactcaggctggagtgcagtggcacaatcccggctcactgtaacctctgcctcccacgttcaaaagattctcccacctcagcctcctgagtagctgggactacgggcacacaccaccatgcctggctaattttttggatttttagtagagatggggtttcaccgtgttagccaggatggtctcaatctcctgaccttgtgatgccccctgcctcggcctcccaaagtgctgggattacaggggtgagccacctcgcccagcccagttcttactactttctagagaaattaagcaaatgaaacaagttagctttaagtttaaatgcattttaccaagttttttatttcaagaatgtaaattcatcttaaaaactgatgggatattttgttctcagtgttcaatccaaatctaccttaagagctaaaaaaaaaaattttttttttttttgagacagtctcgctctgttgcccaggctggagcacagtggtgcgatctcggctcactgcaagctccgcctcctgggttcacgccattctcctgcctcagcctcccaagtagctgggactacaggcacctgccaccaggcccagctaatttttttttgtatttttagtagagacggggtttcaccacgttagccaggatggtctcaatctcctgacctcatgatccgcccgcctcagcctcccaaagtgctgggattacaggcgtgagccactgcacccagccggaataacaatcttttaaagtattatttgatgtacgtaaatgatgaagacagccatattccaaacctgcagagcttccctacaatagtatgagaccaatagccaaagtgctggttgctcaacaatagatttatgccagttttttttgttctgtaattccttgcaatcttatctcccctagtaccttgcccaattatatacctcccacgtgcatccatgataactaacaaatgcagacagatggccaaaatgtgagttgaggaagtgttgagtacaaaaggagtttatctttccatttcagtataatttggatcataatctcagaattctgaatgcagtactccaagtcactaacttcaaatggctgactgaggctctgtccaggaaaaaaattcctttgcggaagttccaatcttaatttcctacataaactcagacaatttacaattttttattttttgccttacttcaccaaaaaagcagaatcacagggataaaaatttacataggatgtctaaatgatgtagaataactcattgaaagctcctttatccacgggtgcttacaaaagataaaaagatatcagtaaaaaatggtgcagtaaaaacctctgaaaactctctcctccatgaaagcaatgtgaacactgtgatgagcactgtgagaatcaactgaaaagtagccaaaggcttgcagcaatccagggagtgcttattcaagaaaaaccagctgaatcttggtaaaaacaataaactttgcagtgttttatttgccttattcccatcccactctcccaagctccatctcggccttaaaaactaaccttcctgaatcacagtgaaaatcagaagccatcagagggggcaaaagaaagctgaagctccttcaaagcccaattctcagagaactgtcattatttgacctgtctggtggtcccctggagggccccgctcagaaggctgtctttactttacaggacttggagcttggccagtaggaaaagcataattcttttgagggtttgatgaaaacaattacagggattgtttaacactgaaacttcttgaggtggtggcaaacagctggggcaaacaataggctaaccaaaagcttcaaaggaaaaactgaagaatgagaatgtccacaaagggctttgaaaagttctaatatattaaaacaagaaggaatctagagggctcatgcgtgcccatggccatatgaatgctcaggaaaaactagagaaagccctcagctctctcctctgcctgaccttgacaggaagtgaaggctaaggcagaggcatcaactgcttagtgcagtgttgaaggtaggctgcacctgcacatacagcccttcaacaaagactattagacttcgttgagacttattagtttcaggcatctaaggaaatctgttcaagcattagctgactactaatctaacaagcagggacttcactggccacacacagaaagaacacagacatcacaaaattagtttagaaaagtcattgaaaaaacagcaagaaggatgaactgtgatgaaaagagaaaatctgatttccagggtcacattacattattttaaatgtccagttttaaatgaaaattagaagacatggaaagaaatgagaaagtatggcccatactcaaaaaaaaagcagtcagtagtaactgcccctgaggagcccagatgttggacttagtagacaaagaatttacatcagctatttaaaatatactgaaacaactaaagaaaactatgtctaaaaaactaaagtataagaatgatgcctctcaaatagagaatattaataaataaagggatagaaattataaaaaataaacagaaatttgtaattgaaaagtacaataactgaaataaaaaattcaccagtgagattaaaagcagtttagagcaagcagaaaaaacaaccagtgaacttgaagacagggcaattgagactgagcctcaggaacaagaagaataaagaatgaagaaaaataaacagagcttctgagacctgtggaacatcaagtgaatcaacaaacacgtaatttgggagtcccagaagatgaggaaaggggaagaacaaacatttgaagaaataatggcccaacatttaccaaatataacaaacattagagaggttcaaaaaacttcaagtaggataaagtcaaagagatctgcatgtagacacaccatattcaaaccattgaaagtcaaagagaatcttaaaagcaaaacataagaaaatatactcttctgaaggttgtctacaaatctatctgaggcacagtgtggcttcaagattagactttggagtcggttttgtcatgtatgtctttggaggtaatgcggttgggtacacattttatataactcatggggaaggtttttctcctattataatttttgggaataacaataaactaaattctacaacccaggtgagtgtttagaccccgaaactcatctccaagcagtaacagattctaagtggaaataaaaaatccactttttcaggaaaaaaaaatagtaccagcaactcatggtgcattaacggcacttatgtgggaatattcttttacgtacttgaataaaagactcaacttacatatggtgcctgattaagagtttcttaagagatatgaggtaatcatcatttttcttgatagcttattcaaagaaaatactgttacatagtgatctcagtctgaagaaacaaaaaaaaattaaatctctataacagacctaaagcatacacgtgactaaatttcccccctcctcctcccatattagcgtaaagaaatcaagaagaacaagaagaaacaccaagataatcagacttttttttttttgagatggagtcttgctctgtcgcccaggctgcagtacagtggcgcgatctcagctcactgcaacctctgcctcccgggttcaagtgattatcctgcctcagcctcctgagtagctgggattacaggcacccgccaccgtgcctggctaatttttgtatttttagtagagacggggtttcgtcatgttggccaggctggtcttgaactcctgacctcaggccatctgtctgccttggcctcccaaagcgctaggattacaggcctgaactatcgcgcctggccatgataactgaactttttcttttaggattcaaaatagggtaaacaaaaggttactgatttctctaaatactgttcctatgcttcttatatttacacaatgtcttcatactaaagtacaagaaaccacttgaaaattatttttaatagaaacaaatcactctcaaatggaagaattacaacagaatacatactagaggcatatcactatgttcttcttaagagcattattatgtcataaaatttcaaactgccaagcgtggtggctcacacctgtaatcccagcactttgggaggccgaggcgggcggatcacctgaggtcaggagttcgagaccagcctgaccaatatggagaaaccctgtctctactaaaaatacaaaattagccgggtgtggtgacgcatgcctgtaatcccagctactcgggaggctgaggcaggagaatcgcttgaacctgggaggaggaggttttggtgagccgagattgcaccattgcactccagcctgggcaacaacagcaaaactctgtctcaaaaaaaaaaaaaattcaaactgtggggtaactgaatagtttttaatccctcttcctcagataaagatgccacgaaagaaagaaaaggtaaaaataagatgtcttacttaagattaggaaaataaggctgtaataatttcaaaaactaagtataaattaatggataaaaatattgggactgatgcccatggaagataaaagctatactgggtagtctctagtcttcatgacagatattcacagatggggaagactaccccattttccaggcttcccaaaactaacctgtgataattagacattcattgtgatccagcacctcagtgaagagccgtgaaataatcaactcaggattgattaaaaagcggatttcttcttgcacaagtcctgcactggttacaccacctccaacaaaatgatttgcaaaatccacctgttggggaaatgtgacattaaataatggtcaaaaatacctacacatatgatcaagaagcacatagtctctaagctctcatcttttcctctcccatgaaaatcaatccccaaataagtaatcttcccaggaagggcagattttggttgcttaagctctttccacctcactgcagttaacatctctgcacatttttctggatcccagaaccagagaagcaatctggaaaatggagcttttaggcaaaatattatgaatcatacagactcttgtttataaacctatttgtgtctcatgggccacaaatcaagggaggtctttatctgggaaggtttcaaagtcattctcccccattcactactcaacttccctttatgtatttcacgtgactttaatataattaaacttttcttatgtaatatggtaaccaaacacttgccctaaagaactgaaaagtttagtaatcaactttttgggtaaccttttccaactttattgtaagaataaagagatcgaatttttgtccttctaaattcaaccccaaaccccaaactacatgaacattacaaactactttttaaaaatataactaaggaaaaaaggaagaaagaaaacccagtatagcaacaaagattcaattaaagtaatatttccaattaggttggaaactcttaagctttatgtggagtagtatgatgggatccccaaatgcctactaataaagaagaattacacaatcctccagagaaagcaaactcaacttgctggcattatttccgtttgtccagtgtgtccagcactatgccagcctcatgaagcagtatgtaagaaatagcaaccatcttttccttagtgagactatctgaggagttagatcacacacacacacacacacacacacacaacttgtgtatatacatagtcatacacacaagtaaaataggatttactaaataccatgaggcttatattctttcaaactattttaaaatatacgatttcttaaaacttcagtgttctctaaagcaactgatactaaatgacaatctgaagcctattttacaaaatagtaaaacaatagtatgaatcgtttgatatgtaaaaatatatgtcaaaagacagaaattaatagaaggcgaagcagtcttcttttaccacaggagaacttagaaaatactaaaacataccactgaggagttcttcaattgagctaccagagagaatcatatatttggatttgtgttctggagtactaaaaccaatgctaaaaaaccagagtaactctttagcttaaataggaaaataattttggtgaaaccagtctgttgattagaattagctacctactacatatgaggtctatgggcactgggtgattcatggcttaaactgtccaattcaacaactatttactgagtattgtgctgggaatcactggatacaaagatgaataagatatgtatggttcctggcctcacggcatttgcaatttagatggcagtcagaatgagcataagcagaatgagaagatgattattgaagagcttgttactatgtatttgatactttctaataatacaattaactaaaattggagcatgggaggaagataggaaagctttacaaggggatgtggcagctgacatgcaggctgagggcatagctgcacaaggacacagggcaaaaaaaaaaacaaatgtaaatcactgtatgaggggaatggtaaacagattcattgtgcttgcctgcagtgtagagtaggtggaggcttacagttggtgatgaggtggtctgaggtctagggaatttttactcaatttccctctgaaggttctgggaaagattcaagtaacacctggacctatgttttaggaagataattcaggctagagtttaaagaataaatggaaaactgtaaaactaaaagtaaaaatgctggttaggtgagtactaaatagtttatacaggcactactagggcctcaaacaggaaagtggtaaagtaaaggaaagagaagaaactcggtaaagaaataaaatggactgtacttgagaactaagagactggctgagtgcctaaaagtataatgatattgtgactacaaatgagaaacagatgaggtttaagattggcctaacttaatttttactggaataaggtacataacaaaaataaaaagataagctctatccaacttatgtactacttgataatgatgatgaaatacattcaatgtgtatgttattgtttactctttgaataaaaggcccacatttttaacttgaaaggtgtacacagaaataaagacactaaactcagtatgcctctaaatgccagagtcttttagaaaaccaaagttttactacttaaaaaagttcttaacaataaagaccctctacaacagttgagagacctgttccagtacatgaaaacaagaatgtgaatgcatccttatttttagccagttattttccaagtcactttaaagctactcattcagattactcagcttctgaattataacttgatgaaaagacaggaatgataaagctcctcagagaggttttgttgttgtggccattcagcatcatgtaatttatatgctacacaaggagctctgtagcattgcaatacaatattccccgatctcctgcggagacatggcatgggtagggagaacaattaatagaaagaagcccttacggtattctctaatctaccgaggtctcacatttccatctataatatattccaaggaagtggggaggatctcaaccttaactgttgttaaataattccttgttgaattgtattgtaatgaaaggtcagcattcctgtggtgctaactagcagtaactttgtttagttcatgtgtattaagaatctctcagtttatccaagactttaaagatggaaagaacttcatcaagaggggaatgtgggggaaaaagtgatactaatttgaaccaatatttaagcatattttaagattattttttaaacagaaaaaaggtataggagtaaatgcaaatttaaatatgttttgtttttgtttataagctcaaataaccactgggagaaggtgatttagaataaaacatagtttgtctctttgaagattttaattacaaatatgtccaaataaaaggccatttaaaaaagaatctcagtttcatttaaataataactagacgtaaattttatagtgagcattaagttattcaaacaaatcagtccattttcaggcaactgctttctttagattctgaaccaatataagcaccaaataagaatctaagaagaaaaataaactattatcagtataaatgagatggtatacaagcttctttcaaagaaaactcagtttacaatgctcttataaatgggataagaacacaaaacactaacattagtgaattttaaagaagcattataaatcaaaagattaggttagatattactatattttaaacacggggcttttgttaacccccttctccaaaaatactttttaaaggtaaaggcggtaacagattattaacaaagattgagaagtggaccagaattacctgcttttaacagggaaaagacatagcaaacagctagctcacgtgcgtgaaactgttacatatgagagagaggcctttcttatcaatcagttttagacgtctgccccctcaacctaaacaaagctgttggtggcagaaaaacatctccatctggtcatcaactggggcagagcaagaagagcctttaaggaaaaagaataaaaatgcctggtgacagtctgtcaagactataccctgggaacttcctccactgtcaacctactatcaatgtctgaaccaagaggctgatgctgtccagatcttgggattttctgtcaaaggctttttagagaagcacatataagaaacagagagtatacactggcaaatcacaacattaccaaggctgtcaaagtgatctgtttggtgtttttcttcattctgctatcatgcttctttgcattaaatcagtttaggagacaaataaacagtttttcaaatttcttttgctgtcagaagcttgacaagaaaaagtcctaaccatacacagacactactaagattcacctacctgtagcatgcctcggccattttcttctatggtaccttcgtaagtgacatgcaatcgtgtcaagggtttttcacatctacaatataaaaagacattcccttatttattattttaatgacaagttgttcactgcggacaaaagtgaaaatataggtaactattcaaaaaccgaaaccaccccaaatctcgaaagtcagaaacagatgcctactgttaacattcttggtattgatcctcctttattcaaacatgtaaatatacatatttaaattaaaattggataacatagtttgaaacctgattttcctctaaataatatgaaagtttttcttctttaaaacagttgaaaaacattacaaaatattaaaaaaaattaagatctatgaaattttgttatggctagagttggcaatctgaggaaaaatgtagaaaaatttggcaataaatcatatatgattctcttctggcttccattttctattttcactgtttcataaccgtgtgtgtgtgtgtgtgtgtgtgtgtgtgtgtgtgtgtgtgtgtcttgatgaaaatacctgccacagaaattctgaacaatggtatttttctattaataaggttaacagataaacttagtacctgtaatttagaaggcataattattttctttccctttcaaccatggccactgaggtatttacttgacttatgttatattaacaacaaattccattgtattaaaagtatttgttaacattatttgccttattagatatttttcccctgatcacttactgaataaaaaatataaatgaatgaaacagaggagatccaaagttctaactcacataagagtgcccataatcttttttgggagggaggagatgattatatttttagaaaatagtctaggaggttagctggaaaagtactgagaattgtttgattccttcctggtttcaatgagtttaaatacatttctggcaaaactccagcccaacaggctgatagctttaactcagaaggtaattctgcacaggttctgtctaagagccttatttgtattaactcattgaatcctctcaacaaccctattactatctccttttatagacggggaaacaaagcacagaacatctaagtaagctaaccaagactagtgaaataaagcagcagagatgtgaaactaggtagactcactcaagctctgaatcagtatgctacacttttagaaaaattactttcccagtctcttgtagaaaacagtacggtaagtttgatatatttttttaacttcctttttttggtcctactttcctagccattttattcagaggaagacccctgtaagcatactactaaaaagataaagaagcataatctaaaaatctctgggctgtcagtcaggacttcagaatgggaattccatctgttgtcaactattctccatgactgaagctagaaactttatagtatagctcttaataaaatcacgaaattgctagaaactttttcttggttttgttttgaagcattttctaacttcccagtaggtcatcctctacacccccgccccaggagtcagagacgtaggtgattctggctctctgtgattaagcctggctaaagtatttgctgataatcaaagggttaactataacatgccagaaacatggaattcaggaaagcctctaagttcctggacccatttagccccttacgcttgggaacaccaacaatccttatcttttcttcattctccctctttaagtgaatgcatgtttctggttctgtggagtctgggagactggttttaattatattctccaactcacttataaagcaactaaaacaaaaaagagatcaatgaaataaaaataagtcaaattctgcctatcaaaattaaggggacaatcttcgtctcacttagaggcaaagttactgtgtctcattgacacagcagccttgccagtctctgcattttgacctgtcccttctctcccacatggtggtatacaaatgggtgttctttcacattagtgccaaatgaatatcagatgcaaagtagagatcctggatgacttaaaaataagccctcagattgatctataaaatctacaccaaagtaacaggaacaaaacatatgcattcctattagagattaatagaagagtgaagaaaaacaatcctctgcaccatagagatgacacagcagaatggtacttttaattccaggtactatattttaagagggcccaatgaatgggagtatgttaagagcagagataaagggtttagaatccatattacatgtgaaatagaagaaacgaatcagtttagtatgaacttgtatgcactgttagagagggaagtaggttaagaagccattaagatacatgaaggagggtcaaatgttaaagaaaactagaaattcagatttatttatgtagctccagaaggaagaaccaggaatggtggagaatgaatgtagaaaacatttttagtgaatgaaagcatgagatgataacacaagcagccaccaatggaacaaactgatacgaaacagcggatctgccatcactgaagctatccagtcttctgtctgttgcaggtattacagagctgatcaagagttttagcaggcggctggggttcctttcagatctaacatgccatgatgccaaaatgctgtacatgttctcatctttttctggctcatttttttttctctcttcaggtcgcttaaccttttatctacttccctctattaataatcatctaaaccacgcactcagtcttctgaagtaaatttctttatctttcacttcacaaataaacatctttgatggatgaaaacactgcaggaaagccacctaagcagatatgacttctcaagttaacgtttttttaagtgatttccattcatcactaattccaaacaaaacaattacaaactatcataaaattattagaaagtgaaaatgggaggcattggttaaatatgtatttagtatgcttcatcatgtcctcaaacatatttaaaaagttaatctacacttctttaagtgtcctgggggacttgctttagattaagaaatatgttaactatttcaggacccttctttaagtatattgggagacttgctttagattaagaaatatgttaactatttcaggacactaaggactttacaaatctgaattagctcatattggctgctatctcctcaatattttctgataaataagaaacaaacagtaaatagcaacttccacaaaatctaccagtagtacacaagggcagccaaacttcaaaattcttgccactcgacgaactctagatggttactgtttactaaaatgtaaataataaaaagacttttctcaatcttgtcctccagaaagaaaagccataaagttcaaacactaaccaaaaaaaaagggtaaggagaaacatttaaatattggtgttccttttattagtgtcttcacatacaacacttctcaattttaaacaggactttgtttcagaagacaaaaccaagacaaaatggtagaaatcaaagggttatagactttgatttaaaaggcataaccttttcaaacatgagagctatcaatgaatcatttatgagaagaaattccctggcactaggataaatagaggttggaaaaccatctttctaggtgctataaaatagaatcctctcatggtgcaagagtccttctatttctagggggtctaggattatttttattattgttgttacctttcccattctggaaaatcttcaagactctgtcttgtaaatgtcaccaacccagtaggttctacagaagcaataaaagaaaaacatacccaaaataagtttcaattttgaaaagattatacacacacacacacacacacacacacacacacatacacacacacactcggtaaaagaataggtctaacattggctataaaactaaccaggaaatacaaagcctagcattggaaaataacagaatattgattgaaaataatatccttacagtagaaactccttctataaaataataagacttcactaaacgaaactatacaaataacagcacaacagtaggatttgagtgctggtatttttggtaaagtttttgaagctgaatacacttttttttaaaaaaaaaagagcattgaaaaaaaggatgtataactggtacagctaatgcaataaagacaaaattgaattcaaatttgtagactcctttacaaagaaaggacttaaccctacattcaaagactggagaataaatacacatttatgtactatatggtaaagtgaaatgtcacagatttaaaaaggaaatcatttgcacatcctctggagttagtacagctaagtctcaggcttaaatagtgggcaatcactctacttgttagtagcagtcgtagccagaggagaaattactggttctaagagtttacagaacaaagatgacatatttttcaaggagcaataaatttgggaggatctaaatgaagtactattaatgtagtcaataattttagaggatgagatccttttctagtcagatttatttatttattttttcaagctagtagcaaaagaaacaaataaatcagctggccagaagtaatttgtctgattcaaatcaaagaacaaactaaaaaggccatgccgtttctgttttcttgaatacaaaaaagctcttaaggaaagagagagatgtcaggaactattagtgatgacagtgtataacccagtgaaagcctggccatcatttcattcctgtgcacaattccacatttccttgttctcagtcaaaagcaggaaccactcaaaaaccatatggagcagttgcagtagaaaacaaatttttttgttaagatgggtcttacgtcttttagatacctaactttaagataaatggataacatatttaaaactcacaagtaagtggtcaaacaactcaaacactagtgaagcaattccatgaatataatagaaaacatctctcttgtcattcggtaacttagcagagaagaacatcaaatgtccttaatatatactaagagatgctaaaagaaattcataaacactgctggcaaagcaagaaaaggcagaagaacatggtttcttagattaacaaaaatgccttgagagcacgtctgttagcgttttttcgtaacaaggcaactttcatctcagaataggatactttgattaatcaaatacttcccatcataaaatcacaatatatactatatacaggtcataaattttcaaaaacctgatctataagacactttatctaaaactatatagaaagtaatttaattcagaaggctttttaaaatacttcagtctcaagatcttcatcagatataaaatacacatgtttaacaacactgaaaagttggtcctgatggaattctagtttatcaattctaaaaggcatgttttttcacatgttacatttctgaaactggaatacatcttttataatggaggtatcttaccataggtgtagactagaggtgaattttcccagagaagatgtgcatctgcttctgctgtcgtctgggaacactatcagcctgataccatctgaattaatcctttgtggcaggcctttgtggaccacactggtggtaaggctgcacactcaaagcttagggcttgtggttcaaattctcagagaaatgtttttttcctttctctatttagtgtcaaggttgagacttgcacgtttctttatggtccctttcctggaaggtcaagttaatttctcatttatccttaggtgtaccagccttgtgggtcatgtctcctactaaactccctgtcctgagtgttttttccttcttagaggtatataatataagagcatttttaaaaagtcatctatgacatctcagattcgatgaaatatggtaccttaaataagcttctgaagtctattgagtaggctccagaacttctacacaaccactcattatactgcaacctcttttattctctttagtatttcctcttcaaaccattagctttacacactgaagaccaagagcaatgttgtactgtatttctacaaagaacttaattaacatgtacagtgaaaaagtcagaaaataaaatgtctagttataatttatttcttcaaattcccaatacttataatggcatatacatttccagctgaaaaaacaaactttaagctttttcctcaaagtatctgaaatcctaaaatttagaaagccaagttagtttttagagaagacatacatgatttgactcccaggacaaaaaagtaaactctgtactacttagttataataattctacttaaaacggcaactcaaagtactgtaaaaacaaaacaaaaaaaaacaatagtaataattctaattagacctagaatggccaaaaaaagcagtcatttatttatttttttagacagagtcttgctctgtcgcccaggctagagtgcagtggcacaatctcagctcactgcaacctccacctcctgggttcaagtgattcttgtgcctcaacctcccgagtagctgggattacactctcccgccaccgcgcctggctaatttttgtattttttagtagaaatggggtttcaccatcttggccacgctggtctggaactcctgacctcgtgatccacccaccttggcctcccaaagtgctgggattacaggcgtgagccaccgtgcctcgccttacgtagtcatctttttaacaagtcattacaaattctaatttgattttgtgtctcataggtccaaatgattctgcattttaatatttcattcagtacagggcacaaaactgaaattcaataagctatgaggtaattccatatcagagaagcatgtaattttcccttaaatatcaaaatcctgataattgatttcattctaaaaatttaacaatgtccaatagcaatacattcaagggggaagatgccaagcacattgtaatgcaagagtaaaagaaggatatgagaaaaatgaccttaaaatgattcaaagacatattttaagacaatcctatgacccagaactgaaaaaaagccatttcacttgaccaggttgaccttacctacttagcacaaaggaacttttgaggtgttctggtttacatccacttgtaggaaaggctacccattgataatagcttacatttattaagcatgtatcttcttgtttaatatctataactaccctgtaaggtaatggccgttattatattatttcataggtgataaaactgaagcttagaggtgtcaagaaacttgaccatggtcattcagcttctgagataagagtggcaataccaatctattatcagctggtcattaccagtatttgttggacatttactattactgtgttagctgctatcagtttttggggaagcaagaatgttaaggttcaatagaggaagatggagatataaaactcagtacaaaacagttttataagaactccacaaagggcttaggggggcacaaaagagaggaatgggtagaaaagcaatgcgttagttgacttatgcaaataaactagtgaatacttctttaaataaagagcatccaaaatttatttcctggtcaatatactttctctggtttttattcatgaaaatcttttgatgtatattacagatttcagagaatatgggtccgatttcagagtatgtaaaccccgccccccctacatttagcacacgtttatgcttatacacaacataagcataaaatctaggttatattgtcgcatcattactagtgtttcaatgtggttgggacaggaaggtttacgttaaacacaaaatgttcctcacatgtcacttgacttgaactgttcccatcagcaagaaaaattacagtaagaatgaaaggaatttacttttctctgtgactcttctaaagtagcagaagagcgttttaagtttctccggtttccttgatgaacgtccctcaaacaatctaaaagagataaaaaataaaagagaatggaagataagttaaaatgccttaatgattcacaaaactacatccatattgctaccaagtaatacaaagaaataattcttccagaagacaattctgtaatgataagaactggaaaattggtttagattcaaatggcatctggaaagaactgaaaccaactagaaccagacttcttcaaagctgctcaaatcagacatcatttactaccaaccacatttctccaacctatcttccaccacagagaaggcaccatccagccctcccagtcaactggggtcagtcagtcagtgcacagctactttctcaatggctaataacatttataattcataatgttactacgtagtttgataagtaacaaaaacggtatcaaaaaaaatccttatctgagtgtttgtgaggaaatgagagtggaggggaatgggggtagggacacaggcaggtataacaagatatcagggctcaacaatccttgttaaacaactagattcttttatggactgaatgtttgtgacctctcaaaatttatatgttgaatccttaatccctaatatagctaaatttggagatagggcctgtgagcaggtagtaacagttaaatgaggtcataggggtgggactctaatctgatagaactggtgtcattttaaaaagcaaggtgagactacagtactctccctctgccatgtgaggacaagatgccagccaacctataagccaggaagaaagccctcatcaggaaccaaagcagcagcaccctgatctgcagcttctagcctccagaaccatgagaaaataaatttctgttgtctaagccacccagttctatggtattttattatggcagcccaagctgactaatagagatcctttgcatggtaaccacaacagtgcctaccctgtgtcatctagttttcagcaacccggacttggattacttaattccgttttctttgaaatgatgtggcattgttattggtaacatacaattcagtttattctgaggaaagaaaagcagggctttaaaagcattatgacctgagtaagtagctcactgaaagatttctaacacaaaagcatgcttttgagcataagatctagctttccaaaggcatttaaaaattatagagactcagtggctatgaatgatgaggtactcttcatctgcctctagtcatgtgctctgactttaaaaccagagacccttcaagtaaagtccatgttaataagtgctgaaatgggtaattatttttcatgattacaacagcaagcttatgtaactacgctgagagggaaaagttaattccatgagaaaatcctattgagcgactgaaataaattaggaaaaggaaaggaaatgcacatttcaaatggttccgttttcaatgatctgaaatctgtattcagggtcaatttctggaaaaacaatttatatgaatatttatttcctaaaaagaatactaatgtatgctagtattttaaccaaatctaaaatcagatctctttttaaaaatagtttaagacagcctgtgtgataatttttatttaaagaacctatctttctaaaatatttaatacacatactcttataatccagttgccagctgaaagaaaggctctttgagggtgcaggtttcagcatggcttcttctagaatagagtttatttaagtcaaaatgaagaagccacatggcagtttaattaaacatcctatatcaataaatatgatttactaaatgaatacctaaggctccactgcaaaatctctttctaggctcactatgcactagaggaaagcaatatgaatacaaaagtagccaccaccttttcctagagatgaattgatgtactatacaattcaattaaaggataaaagttcttcttcaatagaactattgcatagtgaggagaaaatggctgttgctcttaagaaataattctctaaaacataggaaaagtgtccctagcttccatatgcggtcatctgtataaaatcacataaaaggtcacatacttcacaaccatgatgacaaattattaactttaggagcctcgtgagactgcagatttattatcctggcgagacagactttcctggaagattttatggctgttattatcacccactacaaatgaacaccactgtttattttgtaggtacaaatcttaaaggtacaaatcaagcagaatctcaatgtactctgtttattcactgctccaatcctaacttcaaatcactgtgtaaccaaatacactttcccatcttcctgatagagcagggggaagtgggggaagtgtcgtggtgggtgtcgggggtaagaagtggagataaagtcagaggagatgaagcaggtttaaaatccttgtgacaattctcagacttggctgttgtgaaattttaaagttgtatgcacagccactcaaataaaatgaattatcctgatatggaagcaagtaaaaataacataaatagacaggcaaacagcatgaatgaaagtcatcccaggagtgatatacaatctgagggacagcttttgggaatgaggaggaaaacaaaaggactgaggctggagcccaagaaacgggtgaagggggagaagaaagatggggcagggaagatagagagaagagaaaggctgatagaaatggggttagagaaagagagcatgagagacagacacacagagagaaagacatacacaaacaggctcagagaaagtgaggccttctcataatcattaagcatcattcccccgcccccactttttttgtaaacttcccaacacctttcttttttaatttagatttttcaagtcctgggtatgtatatttgaaggcatattttaagtcagcagtgtgcacacaaaccaggccacaataactcctctacatgtagggaggacatttgggcatttaattgaaagataattacagattattaaagaaatcaaacacaaaaagccagtcaggaaatcttactttgttctaaacaaaactgttggtattttcaaagacagacatcagtcaaaggtcagacacttattagctggtgtttttctttgcatacttataaggagaaacagagttgaataaaatctttccctgaatggaatactgataacattactggaattttattctaggtatatccatccccacccccaccatgacccactatgccatttcaagttaagtaataatcccattagtatacagtaaatcaaacccaaagcactacaacctccattttaaaatacgagcaagtgatagtccggaacccagccagaaagtcattcctggctcttctgtgaggcactctgccatatggccccagcagcattttcaatacagggaagaggcagatgtaaaaacctcctgggctgaccactgctgagacccacaatttatctctgaccatctagtttccatgcaaactcagaagcatcgatgctaatcacattggaagcctttatatgaatgtttaggacctgaaaggcaagcagggaaaaaggtcaggggtatttaccataactaagcagggcttaaagaacacagcaataaataaaaaagggaagacatattcaatttattgacttcagcctcccaccacatactcttaccatttttcttattcaactagctagccatacctctcttttgagattaaatacactctcacacacacaactccccactgctagaaactataatcataagtagaaactatgcataaaaggaaataacacaataaaatgctacataatcagcttaacaaatggctcatcagattacgtactggatctttcagaagccacataaaagtggggggactttcagttgtttggcatttccggagcactcagagcattttgctcatgacaggctttgagatataataaaagaacactgagtttgagtagaagacagtgatcaagttccagttgtgctaacaattcatttattctccctgaaccttatcagtagagaggcttccctacctagaaaattccatagacagaatcaaagcaagccatcaaaagacagtatcaatggtgatgtacagttgttgttcctattatttgctagcttaggctcattaaaacacacaccatctcacagtgaaaggcaagtgcagacatcctggctgcttaggattctctacaacattgtggagactaacactaggttacctgccttaattcatttttcatgttctgctatccaaaagaacatccatcacctaggaagacaagaatatgcctgatttcaaatcttcaacggaactacttaaactcttatttggtgagaatgctatttgctgcaagcttaaatccgtcacggtcactctggacttaaaaatggctttaattcatttaatagatcaataattatttctaaaaatagttctaatttttgactagtcatgaggtaagaattattaattcagttcattcaaagggagactgtgtagcagaatggttaagggacacagcttctcaaaggagactacatcctgcgtttgaatctcaagtctactagttactgtgttaacttggtgaagtaacctcccctctctaaacttccacctcattttaaaaatgagtgtaacaacaattcctaatcaatattctaattcatatggttaatgtgacaagtaaatgaatttcagataatgctgagtaagctaaggtacttgcgctaaaataaggcattacataatgcccaggccaaaaaaatcaacattcatttacataaagcagttgcattgttctaattaatattcccttcatttaaaaaaatggcccagccttgattcccatcaagcccaacatgctgactttcagcgctaaccagctcagtcttcaggataaatgaccatgtacaatgaaaaagataaacctgccatcgccaagaagccccaggcttccccactcagaaggttggctgaaaaacaaaggtcttttaaaattaaaatatataataaaattggccgggtgcggtggctgatgcctgtaatcccagcactttgggaggccaaggctggtggatcacgagttcaggagactgaggccatcctggctaacacagtgaaatcctgtctctaataaaaacacaaaaaattagccgggcgtggtggtgggtgcctgtagtcccagctactagggaggctgaggcaggagaatggtgtgaacccgggaggtggagcttgcagtgagccgagatggcgccactgcactccagcctgggcgacagagcgagactctgtcccaaaaaaaacaaaaacaaaaacaaaaaagatatatatatgaatgtaaattctggtaattggttacaggaaattggaagtcaccaaagccaagccttcccaagacatcttgacctctgcctgtcagccatccagcagcgatgggtctttgctccctacagaactctgtggattctatttcttccataagaaataaaatgctatatgctgaataagtaaaatagggtgaagtagacacaatgacaatgtgtctatggaggagtaattggaaagaagctatccacactagcttttttggaaaagcctcaaaaaatctgtgaaattccaccctcaaaatcaaattacaaaaattgtccactcttattaactttgtgttcagcttgatttctgacaactgacttgttcttccctgaactattttttcttctgcacgtaaaagtaatatatgggctgggcgcagtggctcacgcctgtgaaacaggttttttatataactgcaattgcagattccaatgctctgtgttttctctcaattctaccccaattactaacgaaatcagaagtaaaagctatgtttgattatatgtggcttaaaaataaaacatctcgtaattcctaagactaagacataatatgaaaagtaaaagacaagagactgagaacaaagggtctaaattatagtcttagcactctgccactaaccagctccattactcaaaacaagtcacttaattctcaaatatttcatctgtaaaatttcttttcattcattcaagaagcatttattgaaggcctacaatgcatgagactttgtgaaaataacaaagacagttaagatccctgtcccactgaaatgattaaataagcaattatgaagtagtctaggtagtacagtaggaaaagtaggggacagtaaaggcacacatctggctgtacaaacctaaggagtaccttggatgcctctctctgcccatctaccaatcctgtccatcaccatcactctggctaccccttcaaatgtctccacacctctgtcccctcccctacactatcccagctaccatcctctttcccggtgcattgcagtagcctctccaattgggtaaactcatgtactctggcccctctctgcttgattcccacattacagccaaaataaacttttgaaaatgtaaatctgaacacatgtgctagtctccctctacccacatatctaatcctccaatgacttcctgttgttttcagatggcctagtgaggcacagcatggtccagcctccagctacttctgtagcctctaccatctccatgctccttctcactctctgtgctgcaaccacactgtcttctctcagtctctggacatgtcaggtccttcttgcaacagtgactttacacatacttttcccctgcctagaatgcaaccacctctccttctccttggcaaaactcttattcacccttttgtacttaattcaaaagttgcgctgggcatggtgacatgtacctgtagtcctagttactttagagactgaggtgggaggatctcttgagcccaggaatttgagaccagcctgggcaacataatgagacccagtctcaaaacaacaacagcaagaaaagttatttccttgaggaaagtttcctttattaaattatatctttctttaataaaacgtcatggtgctgtgcacctctccagaggtacacacaggctagcataggaacctggagtagcaaacctatcctagcagaatctgagacaccagaaaaactgatacgtgaactgagtactggaggaggaataaaagccacgtggaaaagagaagggcatctgtgacgtgaggtttgaaaatgagacaatactacataacagtaagaactcagaaactggcttctcctttctctgtaaccttatggcacttaatacactgtggggaatattgcagttgctcattgtacatttgaactaaacattgactaaataccagtatctaaaaacaaacttacctactgtacaaacttgaaaaatagattaaaaatatgccccttgcaactaatatttatgtaaccaaggagcatattatatattaaaaaaaaactatcctgtttgctaacactaggattttaaagaaattttcttagataacattatttttcattctttgctgcccctttcttagtgttgatagtagagggtaaccatatataataacaaattatcatcaatattttaatgtttgaaggtcataaaaatataacccaagaattatgacagtctaagagcagcttatattcaagtcatctgctatactttcatctgctaaacacacaataaatgcaccgaaatgtctagtttttaagtttaattaaaaatttacattaggaactaaccagctgaattctagaattcttctcatcttaagagagtaaaacattctccaattttaaaaggctaaaaaatatggtcttcggggctgacactctgatattggagagaattgtgaattcatttctctgctgccatgtggagttataaggaatgctgcccacataaagtaagttgcattagaaacaatgacactctagcagcaatgagcacacctatcacctagatgttggtctctaaataccgttgtacaataaaagagaccaggaatccttgagaaaatggttcattccaggattgaggcatggaaaatgtaagatgaatctggaacaatgtatgattccagaatgaaagttaatgctcaaaaaaaggatagggcttatcaaaagaacataggagtcaacctaaaggagccctaatggccaaagctagaataattaaagcagtaaaataaataatactgtttaatttaaactgacacaacaaaataaatatccatgagtccattctgatattttaaaaacgggggaaaagggatagctcttccttacaatggaatttcaattagcaaatgtagaagagggaagcagaaaattcacaacaggcaaacactatggtaataatcattgcagacaagatgcaccaatggatgccaaaattagtagggataaatgtgaggcaaaacaacatttgcatagtgttttatcttttggaaaatatttattaatcacaaaaggaaatatggtaactttatagtggaaaaagtcagcagacactacctttgccaactgatcaccagtaataagaagtatcatgatcccactgatatggtgcactgagaaggacacaggatcatttctgtggtattctcccaaaaatgcatgacctcattccaatcctgaaaaaacatcagccaaacccagactgagaatattctccaaaataactgtgatgagtactcttcaaaactgtcaagatcacgaaagaaaagaaaaaacaaggaacatgttggaggagactaggtaattaaatgtaactgggatgctgggtaggatcctggaacagaaaaaggatactagaaaaactggtagaatcagactgggtgcagtggctcacacctgtaatcccagcactttgggagatagaagcaggcagatcacctggggtcaggagttcgacaccagcctggccaacatggtgaaaccccgtctctactaaaaatacaaaaattagccaggtgtggtggcatgcacctgtaagcccagctactcaggaggctgagaaaggagaatcgcttgaacccgggaggtggaggtttcagttggccaagattgcgccactgcactccagcctgggcaacagagtgaagctccgtcttaaaattaaaaaaaaaaaaaaaaaaaaaaaagtgatgctactgatcattctacttcagagacaaaagcagtatggcaaacaaaagtgggttttgtttgtgtatccgctctatgactttatctcctactctgcatactgccctaccctcagaggcaggctctgggtgaccagaggcagtgaagggcattacacacagcctgctgggaaaggggcacagattatagcaattttctcaagtctcacactgaaatcagggaagaaaactcacatattctattcatgggtcctataaagataattctcaagtgaagaaagaaacagaggtggggatatgggagtagtgagtaggagggaagaacaaacattaatttgccaagaagattctttaaaatatttttgtttgtgtagaagatagagaaagtagtcacctgggaaaatggctggaatctaaaactttatcaataccttcacactgtattaatttagtcgagcagtttgaacattcttttgtttttcttttaaaaatattacactgataaattaaccatgtctataaagggtcaaaatcacctttcacttttcatcaaaacaattacacttttcaagtctcataagacagctcatgactttagactctcattttataagacctttgtagaaaggaggacttttcctctacctttcacagtatttcagcattaaggaatataagcacaacaaaagttctcgtgaataatcaaactgaagaggcatgtggagtccagagaactggggaatcatctgagaggacagaaagaacatgggccctggagtaagacaggcctgaaataaaatctcagttctgtgacttactagctcctggatcctaatcaagttcttttaacctcaatgaactttaatcaccttgcctgcaaaatggtgaaaatgtcacttaagtactgtaaaaattaaataagacaactgcatataaaatgcttggcctatggaattcattcaagaaatattattagttccttccacctttgtctttttcattgttaaagaggtgttttctgaaaacataccgattgaagttaatgtctgggtaactagaatactccgatttcatctgagcatttcatcgtggaaatgtgcagaagaaagcattagctaaaagactggcaatctgttcctgcgacattgtgatggaatgattcatcttctgtttcaggagtggtattggctgataaaagaaacaaaaaaatacagacgagaagagcaataattagtttagcaatttcaaaagcagaggcaccaaattgcatttgctaaattaaggcagaaataatttcaggccattcttgaatccttaaatcagcaatattgtaaaagtcaagggctgtttatcagggatgattcagaaaatgcacttatttgacaaactgcagatttctaatcaataataatgatagtgaagagaatataaaacattacttattagtgaaaaacaagattgcttcagcaagtaaataaaaacacattgcccatgtaatgaaaaattagaacaaaagatgaaacaaaaatatataacattgtttaagctaaattttgttcttatttatattaaaaattattggctagaataatctttcttagtcctcaataaaatgatctaagataattcaacaaataagtcttaaccctccctcttattccaaattacacttcatactcacaatttctttataagaatcaaatctaacttcattaaagctattaatagaacatgtaaaaaccaccatacggacatgtataagttgtaaaaagataagacatttcttacataaccaaacattccaagtcatggaagatgtaagacatttttccttcaaatcttttatgtctaaaatgtcttctagttatgccaccaaattcacttaccttttatttcagtataatccacacgacctgagtattgtgttcagtgggttttattctgtttgtaaaccaaaaataaagttccaagccccccaaccaactgaatgaacccctcctctcgaccaaggggattccaaagttaacctgaaacactagtccacaccatgataggaagtgtgggtctgacacgcctcattatatgctcctcactttagaattcagcacaagtgaccagcattaacaagaaaacagagaccttaaaactgatgaaacaaatctttttataataataagactcaactccagcctgactcgagtatagcatcacatgacagatagcataccttgaaagaattgaagtattttaccccaaaatatatttctttgacatattttgaaatagccctgcaaagctgtctgttgggaaaatgtacgttctgtaaagaatctctattcctttccaggtgagaattaagaaagggtgtggtacctttttagatctgataaaagctctgaagcctgttacaaggtttcatccacatgataaaaccttggtctccacaaacccttatcttaacccagatattcctttctattgattccaggtctttgactcttccaaccaattgccaatcagaaaatctttgaatctacctaagacctgtaagccccccttacatgtattgattgatgtcttatgtctccctaaaatgtataaagccaagcctgaccatcttgggcacatgttctcagatctcctggggctgtgttacaggccactggttactcccatttggctcaaaataaatctcttcaaatattttacagagtttgactctttttgttaacatattttaaatgttaaactatgtttttaaagacatgctgataaaatcaaagaccaactaccagtttatccttctgctgttaagtttcaaaatgctcccacagaatatttagagatgcatttcattctccccttcagtaagacccagaactaagagtttcgggtaactgcactcatctcaaaatggcatgcctagagcaaactgtcctgatcatacctcaggagtggacacccagaatgaacctgaggaaagggcaggcaagacaaaccaaaactgcggtgctgaataatgaatgcttttctaagtacagaagtacacaccactgctagaataagagtttgccagaaaaaagaacagattaaacttgtaattcaactatttctcttggaaaaattcaaaggtaaacaaataagcaaaaggtaaagaatgtattttcactatgtttacaaaattctctccccttcaggtcttagcaatcaccatttctgagaaaaatagagagctcatattgatctccattttccatcctgtgcatttgttcacaaccaagcaacgagtttagaaaaggtgacagtgcatcaatggcttcaagcaaagtgctgcttggttttaggaagaaatgagtttttaactaccatttaccaagttattcagaaaaatgattttaaaaattaatggtaaatatttcaggcttaatggacttcaaacacaaacatttcttgtctcccaaataaacaaatagtataattttaaatagagttaatgatttctcctctcttggtgaggagaaatgcctaaaaactcattatttggagaaatcaggagatgtaaatcttactgtcaagcaatcggctcaacaaaataagaggctggttactgtgaaccaagatatttcaaaaagttcctgaccaaatttgtttcctttaattttattttgataaatctaaaatttaccctttagatttggcctagagtacttcaatgtgataaattattaaacaccaacatatacaatttaacttgccacaagacgtattttgatctcaaataaaaatcttaactttcacagcagagattgacttttcaatagggggcaaagcacagaatttccatgcctacccgttgatatgctaatggagaagaaagtcactgagagaagccaggacaaaaagctgaggactcaggggtctgattttggttccaagggacttgttatagcttacaaagtcagatacctttgaacaaaaatttctcattaaataaaatatggaaactctcatatgcacgaggggaagaggattaaatggcccacacccaaaggctacctactacctattattgattatgaactacatattgaattcaaaaagcatataattaagcaccatgcaaaccagggacacaaagaggatctccctttaaggagactataatccagtggcaagagatatataatgacaagaattacaaaacaatgatttgagtgcttcaagagggatgaaccttgcctgggaggcagggaaggcttcacaggggaagtaacagacaggcatacctaggaggtagggagagaatttactaagtaaggagagaaaggaaaaagaacaaacatggaatatgatcaagcaaataacttccaacagaaacaagaagatatgttttaaaatatatttcccctgcccaatagtaaaacttatttcaggcacaatgcattactgaggtgaaattaaagttacataaaattgaaaacatcacactggaaaacatttcatgggtctcaactgaaggtggcatagtccaggaaggcatttggacatgtatgggttgttttctggttgccccagtgaccctatttgtggtttttggggtgtcctaatgacatattgcaatgcatgggaccattatacacattcagaaattgttccacccaaatgtccatagggcccctgtggagtaaaatgctagcagaaccctggctagcagccatgcagcaagaggcgttggccctagaaataaaagacaaaggcaaattcaagcacggttgtgagaaacacaggaataaaattatgaacaaaacaaaccctgtggaggtttgaaaatacgttcacaaattctttgatgctcctctctttaagaggtggagtcttgggcacggtggctcatgcctgtaatttcagcaccatgggaggcaaaggcgggcggatcacatgaggtcaggagttcgagaccagcctggccaaaatggtgaaactccgtctctgctaaaaatacaaaaaaattagccgagtgtagtggcacatgcctgtagtctcggctactcaggaggctgaggcaggaaaatcacttgaacccaggaggcagaggttgcagtgagccaagatcatgccactgcattccagcctgggggacaaggatgaaattcagtctcaaaaaaaaaaaaaaaaaaaaaaaacaggtggtctaatacccctccccctgggtactggctagcttccaatgaacagaaaaacagcagaagtgatgctaggtaccttgagaaaaataggtcatagaagacactgcagcttccttgctctctcccttggattgcttgctctggggaagttagctattatgtcataaggacaatcaatcagcctatagagagacccatgtcagggcgttctgccaacagctctgtaagtaagccaacttagaggtgtgtccttcagccccaggcaagccttcagatgactgaaaccctggctgacatcctcaccgcaaccacgagagaaatcctgatccacaaccactcagtcagctaatctgctcccaaagtcaacagaagctgtgagataatacatgtttattgttttaagccattaattttgacataatttgttatgtagcaatatataattaatgtactccaaacaaaataaaatacaggattctttatttttaaaagttaaggctggcacagtggctcacacctgtaatcccagcactttgggaggccaaggcatcatctgaggtcaggagtttgagacgagcctggcaaacatgctgaatcctcgtctctactaaaagtacaaaaagtagccaggtgtggtggcgcacgcctgtaatcccagctacttgggaagttgaggcacaagaattgcttgaacccaggaggcagaggttgcagggagctgggatttgtgccattgcactccaaaaaaagaaacttagccgggtatggtggtacatgcctataatcccagctacttgggtggctgaggcaggagaattgcttgaatccaggaggtggaggatgcagtgagccaagattatgccactgcactccagcctgggtgacagagcaagactctgtctcaaaaaaagttaagaaagtatcattaactcatttgttgtagaatttgggggagggtgaggaaggagtgggtcgtattaagccattttgaaaatacgctattccaaatccactagtatgttttgaaataatgaatacttttttaagttagaggttatttaaacaaagagagaaaaaagtcaaagtaaacaagcttcaacagtgtaaacagaagctgaggaatggaatgctgcatttttaatgtccttttgtagtactctctaccctctaaccttttccttaatacagcaaaattactatactctttggcaaaaactgtttcccatttcttctcttctcttctcttcctctctctctctctctctctctgtctctctgtctctctctctctctctgtgaccctggccattcaagtttaagggaaattcaattgtcagtctcagggaagctactgaggaagctacatccactaacctgggtgcaaatatttggcagacagagtgcaattttcaccatatcaggcaagatggactgatataaatgttgagcttctgtttcttcaagtacctgaaaaccaataaaataagttatgtgaataacaataaccagtaaatataataaccaatgaatatgtttgttatgaaattaaattacatatctgcttttcatggaaccccataaagtggcaccctatcagcatcaccaaacacatgtacaaatgcatcaacaggtgtatacaaataaacttacaaattcatttccaaatgtatatttggcattaaggcaattcaccttaatgccctctgaaaaaaatgtaagtatcccaaatatcaaatatccctcacacaacattcacaataaagtaaaaacacttgcaaatggaaaacagtacattctgcccttggttatatcaactagaaactgctagacaccagggactttcttagaagcccccaaggacccatctagtttcaatggtctacaattgaagaaatctccataaaagccacattaattacttcagagcatactctatgggtcaaatctaatctgttgggtaataaacaatgaggtttctgatggtcttagaatttctcttttccagacacccttggaaagtgaaaaccacaattcccatataaaaatttgaagcacaacaaagatgccatgcatggtccatttttgtcttttataaaatttcccctctctataacaccttttaatctaatgtctttctaaacatcagggtatttctttaaaagtactggaaatgacaacactcttaatttagagatactacatatacagtcaggactgaagtaaatactttatctacttgaaatcacattttaactagaagaggcctcagttataatctagtctgagcttgtcactattacagagaaaactgaggccaaggaggttacctgatcatcctacattgaggtcaattaaaaccaaatcagaacaagaacctaagtgttctggtctctatgccacagctcttcctacttccctatgtgaccaatgtttggaatcgatgaagaaacagactcttgacaaaaatcaggaactaagctgaaataaaggtaaaaccatttgtttatctgcagccggacagggtatgtgtgtaaatagaaaaagtaacaaagaatatttgccctgattttgccagaaaattctaacactaagaattttctttacaccaaaactctaaaacccaacctatgtttacttctcttttaaaattaagataatgagtaaacacattcagaatgaacagaaggatatttgtaattcagagagttggaaattcaattagtcataagcatacagaaaattaaacaaaagacaattattaattctggagaaaaagagttgtttaagagaggaaaagcaatcacagcccatatatgaatagtgtttatactatccaactgaaaaaagactactgatgtaattgaaatgaatatgaaaactatagtgagaaaatgcagaggtagaaatgaggtttgcatttatggtagtggagaaagtgagaataagagctaaatcctaatcttctaaagtgggacttgttttaaaaagactttagagtagtcaaatgactgcctctttataatctgcctctttaactctgttaaaaattaaaaaactaaatttttaaaaaatcatatattcatagatgacattctactattttagaggtatgcactaaagatactggcttctctatacctgaaaatatataaaatatattaatgcatttgtttaaaatattcaaactcttcctgtttataatttatctttttttttttttaatagaaacagggtcttgctctgttgcccaggctggagtgctgtggcatgaccatagctcactgtaaccttgaactcctgggctcaaaaaatctcttcctgcctcagcctcccgagcagctaggactatacaggcctttttgctttttaaaactatgtattctgaaataattatagatttacaggatgttacaaaaatactacagaggtacagtatacctctcacccagtttctctcaatggttacatttcacattactataacatactaaaaaccaggaatacctgtacaatgtgtatcattctatgccattttatcacacatacatttctgtaatcgccaccaaaatcaagatgcagaaccattccactgcaataaagatctcatgctacccatttatagtcacactcagcttccttcctctcgctattcctaacacctaacacccactaatttgtttttcagctgaaaaattttgccatgttacctacatggaaacatacaagtcttttgaaattgacattttttacatggcttaatgcccttaaaaggcattcaagttattgcaagtatcaatagttcactcctcctcattactaagtagaattccatggtatgaatataatattatataatattccatggtttgtttagcaatttcacctactgagaggcactttggttgttttcagttttgtactattataaataaagctatctttagtctcaacctatctatattgttgtctgaaatcacttcctataaacagcacagtgtgtcatttttaaaattcactctgcacatctgtcttttaacagatgaatttaggtcatttatgtttaatgtagtctttgatatgttgaaacttaaatctgttatttcattttatttcttttatctgttttcttttcccttcctccttatgggttacttgaacatagtttaaaattccatttttgtttatctaaaatgtttctgactgcatctctttgaatagattttttttaaagtagctgctgaaggactgcattacatataacttaccaacatttactggtgtcaacatttcaccagttccagtaaagtgtagactttaccttcctttaaattcctttacccttctccatttataatcttcaatatttcctctacatacattgataactatactattttacaatatttgaaaacagtgaaaaaagtcaaacataatttacaacactcaaaaaagtttttaaaaagtctattatatttactatatttttactctttgttgttctttcttctttcctgatgttccatgattccttttttttataatttcttttctgtttcaggaaatttctttagacattactttatgttaggtccactgatgtcaagttctgttttccttcacctgagaacactgtggtttcctcttcctttctgaagaatatcttaattggatatggaattctgggttgacaattctttccttagtcctcaaaattttgtgtcacttctttctggtctccatgtttgctgctgagagatccgttgtcattcaaactgtttttctgtataggcattgtgtcatttctctcttgctgctttcaagattttttctttgcctttggttttaagaaatgtaattatagtatgtcttggtatgaatttctttgggtttatcctacttaagttttggtcagcttcttgaatctgtagatttatgacttttgtcaaattttggaagttctcagccattatttctttgaatattttttcagtcccaccctctttcccctccctttctgaccacacaaagacacaaatgttatatctaaactctgggttttgttttttcatctattttctcactgctgttcagactgagtaatttctcttaatttcttccaagttcactgattctttcctctatcatccccattctccattaaacctgtctattccattttaaaaattcagttattatatttttcagttctaaaatttccatttggtttctctggatagtttctttttctttgctgggactttctgtttttttcatttgtttcaagtatgtttataattgctcagccttcttgtgatggctactttaaaataattgtcagacaattcacatctgtattctcctggtgtctattgatgttcatttttcatttcagttgagattttcctgattcttttctggtcatgagggacattttgttgaaatttggatatttggggtattataaatctttagatcttatttaaatcttcagccagagcaggccttctgtgatactgtgccagcaggggaatgggatagctacttcattaccagcaattgagggtaaaaattcatgttccccagtcagcctttagtacccaaagtggaaagtgagagaggtacctcgatagtgctgggttggggtgagagttccagctccccactaggtctttactgataccactttggtgccatgtactctcctagggtcccatagtccctgctggtcagtggtcttctacctttcagagtcttatgtttgttttacatacaaggtcccctgtttttcactgtaattagtgggaaggacagacagaagtgcctattcaaccatgttaaacctaaagacatgaaaccttaagtgtcttaacaagctgacacgtctcctttgggtatccatctttgtcttttaaaactgacatgagtggctgctgcagtgctctgctgacaagctttacaatattgcttatttatctgatgaagcattattgcactgtacttcttcacaactgtcaacactccagacctatgtctaatgctgctttggaaacacaaaaagggaacctaaaaatgtcatttaagaacataagcgactcaactactgtttgagatggaatgcataatctaaaatatcaccatgaccttataacctgtacaatgcaaactgggatgcaagtagggaaaagttatttaagatgtacatcatttcttaacttcaagaaaagcaagagccattggtcaaatcttctataacaattaaagaaaaataaacatacattacttattatgatgataatgatgattataagggaggtaagcatttacatgatggtaaaaaaagaaagttgtattaaattctcccacaagtaaaaccctgccctctactggatagtctgcatagataattacatacagcaagtgttttgatctgtgcgtgtgcgcgtgtgtgtgtagcaactttttattctagtcccacaaattggctgtatatatatgtaatatatattatacatatatttcagtcaaaattgatacaataaatttcaaaattatactgctattttgcctatctcctttccttagattatagatatgttcattcattcgattggctgataaacaaatacctgaggaactattatgtctcaggaattgtgccagaagatgacagaagagtaaacagttaacagacgtggtcactgacctcatgaatctcatggcacaaagccctatcctctccctgtgacccccaatacatcagccctaacctaggagggcagtaataactgcaaccacatcatagtgactgtggacaggctatttttttttcttctctccacaaatagaaacaagctactaaaataaaggaactaaatctgccaaacatcaaaacgttataaatatttaaatatctacaaacatccaaacagaaaagagatatttacttatttcttctttctttgaatatctgattaactacatacatctgttaaatgtgctctaatatttatgaaagacatatttatacatgactaagtaccatacctgacatatggaaagtattaaatattgactactgaactttgaattaataagtgaaatctgtagctcgcaaaatgagaagaccagtgttatttcaataaaagaaaatatttccatagatctttttcaaacagtttagggcaaacagctttaaaaaagtaatcaggccgggcgtggtggctcatgcctgtaatcccagcactttgggaggccaaggcaggcaaatcaccaggtcagcagatcaagaccatcctgtctaacatagtgaaaccctatctttactaaaaatacaaaaaattagccaggcatggtggcacatgcctgtggtcccagttactcgggaggctgaagcaggagaatcgcctgaacctgggaggcagaggttgcagtgagccgagatcgtgccactgcacttccgcctgggcgacagagtgagactttgtctcaaaaataaataaataaataaataaataaaaaataaaaaaaaatcacaaattaatgaatataagaaatagcacaagctgctccgttttctctattggtctaaacctagttagatcctaaaaaaattgtgaaaagttactaacaatcctctttaataaaaaaaaaatgaaatctatatgaaacgtctaggatgtgaaattttagacaatttttcaataagaagtacaccactccaaaagctaaatagcaaagaggatatatcctcataatcctatggtccatatatatatatatatatatatatatatatatatatatatatatatttttttttttttttttttttttttttttgagatagatctcactctgtcacccaggctggagtgcagtggcatgatctcaggtcactgcaacctccacctcccagattcaagcgattctcctgcctcagcctcctgagtagctgagactacaggcacgcatcaccacacctaggtaatttttgtatttttagagatggggttgcgccatgttggccaggctggtctcaaactcctaacctcaggtgatccacctacctcagcctcccaaagtgctgggatgacaggcatgagcctgtaatactgaagatgagtgatggaaacagggaggttcattaccccattttatttttgtgtatgtctgaaatgcttctttaaaaaaaaatttcctggccgggcgtggtggctcacacctgcaatcccagcactttgggaggctgaggtgggtggatcaactatgttcctaatagtaacataaccaatatttatacctaagtttctttttccttttacataggtgcatttatcagtggaaattatgttgctcaatttagtattttttctcaccaaatatgacaaaaaggcattttttacatcactaaaggcaaaatgttttttaaaatgtcatgtattttcactgaagaaaattaatataaacaaaaagaaaagaaatattacccacaagcccactgccaagatatcctcttctcagatataaacagatgcgtatttcctccccaaacttcttctgagaacttaggtgtgtgtgcatataaacacacagttttgtgttaccttaatttttaaaatattatatttttctacaacttgtttttgccttaagagaaagcctaaaaagtctttccgtattatacaatgacaaatgctacacagtattccaaagtagagaagtacaataatttttgtaatcattcccctttgagaaccatttttcccaacgtttttaaaaatttcaaaaatatggtgaagttaaaataactatacactgaatacccaaatactatttggtttctatgattaacattttatatttgcttttgtcatgttgtcatcagtccattcttctgaccacatatcaatgcattttttaatgcgttttgaggtaagttgcaagcattccaccccatcacttcagtttgcatatcagcaactagagttcacgccaggcatggtggctcacccctgtgatcccagcactttaggaggccaagccaagtggatcacttgaggtcaggagttcaagaccagcctgggcaagatgatgaaaccccatctctactaaaaatacaaaaattattttattgtatgaatacacccacaatttgtttattcattctcttgttgatagatacctgggctgtccccaggttttggctattataagtaaaactgctataaacattcttctacaaatctttttgtgtgcatatattttcatatctcataggtaggtatagaaagaaatgaaattaatgggtaatagggtaagtatatgttcagttttctaaaaaacagccagacctttttccaacattgtagtacattttaaactcccaacaacaaagtatgagagttgcaactgctccatatcgctacctacatttgatcttttagtctttctagtgcctgcaggctaatatcttttctagttataactggcatttctccagtgacaaataatatcaagcattttttaatgtgcttattggcaatttgtataccttcctttgtgaaatcctttcaaactcttgctcattttctagtgaggttggctgtctttttatttttcaattgtagttctttatatattctggatacatgtcccttgtcagataaacattttgcaaatatttctccgtcttttaaaatttatttatttctatttatttatgtgagacagggtctcactgtgtcgccaaagctggagtgtcatgatgcaatcacatctcactgcagtcttgacctcccaggcatcaatcctgtcaccctcagcctcccaagtagctgggactataggtgtgtgccaacatgcctggctaatttttgactttttttttttcctttttttttgagatggagtctccctgtgtcgcccaggatggggtgcagtggcgcgatcttggctcactgcaagctccgcctcccaggttcacgccattctcctgcctcaggctcccgagtagctgtgactacaggcacccgccaccacgcccagctaatgttttttttgtatttttagtaaagacggggtttcacagtgttagccaggatggtcttgatctcctgacctcgtgatccacccgccttggcctcccagagtgctgggattacaggtgtgagccaccatgcctggcctaatttttggatttttaatagagaccattgccatgttgtccagactggtattgaactcctgggctcaagcaatgcatctacctcagcctcccaagctgctgagattacaggtgtgagccaccacacctggcctccaagtgatccttccacctcagcctcccaaggagctgggaccacaggcatgtgccaccatgcccagctaattaatttttttttttttttttttttttgtagagacaaggtctccctatgttgcccaggctggccttgaactcctgtactccagcgatccctctgccttggcctcccaaagtgctgggataacaggcatgagccaatgcgcctggcatccctgtctttagcttgcctattttcctaatgtgttttcgtcacaagtatttataagtttttttcttttatagctaaggtttcccattagctataaaagctgtaggtcctaggaaatctttgtcgactcctaagctacaaagatgttttcctctagaagctttatagtttttgctttttcagttagaatttagaattattttctatgtatagtatgtgggaaggggcaatttttttttttaagcccacatggaaatccagtttcgccaacaccatttgttgaaaagacacttcttttcccttgttgtattgctttggcacttttgttgaaaaccaaatgactgtataaacatgggtctgtttctgggtttaccacttggttccactgatcaatttgattgttatgtcagtatcatattgtattcatttccttgagctgctgtgacaaagaaccacaaaccaggcggcttaaaacaacaaaaatgtattatctcacagttctggagtctagaaatctggaaccagttgttggtagtatcacgctccctatgaaggctctaaggctcttcctggcctcttcctagcttctggtggcttctagcaatccttggggttccttggcatgcagatacatcagtccaatctctaactccatcatcatataagcgttttccctcagtgtctttgtctctgtgtcctttccttctctcataaggacaccagtcattgatttaggatacaccataatccagtgtggcctcatcttaactagttacatctgcaaagactgtatttccagataaagccacatcctgagagtccaggtgaacattaatttggggggacattattcaactcaccacacatactgtcttgtttactgtagtcttattgtaagtatccaaagcaattcacgtaagtctgcaaactctgcccttcttatttacaatttctttgtaaataagggtcctttgtgtttccatataaattttagtaatcagctttgcattttctacaaaatgcctgcttggtattatgattggaactgcatatagggagaactgatatctttttatttttttgagatggagtttcactcttgttgcccaggctggattgcaacggcatgatctcggctcgctgcaacctccgcctcctgggttcgagcaattctcctgcctcagcctcctgactagctgggattataggcacccaccaccacacctggctaatttttttgtacttttagtagagatggggtttcaccatgttagccaggctggtcttgaactcctgtcctcaagtgatccacccacctcagcctcccaaagtgctcgattacaagtgtgagccaccgcgcccggctgagaactgatatcttaaccacactgagtcatccggtccatgagcatggtagatattcttttattcaggttttcttcaatttctcccagcaatgttttacagtcttcaagatactggtcttacacattttttgttaaatttatttctaagtattttatggttttttaacactatttttaatgaaatttttaaaatttcatttatggtaagtatataaaaatataatgatttttgtatactgaccttatgtcttgctaaataaattagttctaatagttattttttaggtttcttgggtttttctgcataaacaaacactgtcaactacaaatagaaacagttttacttcttcctttctgattttcaaacattttatttctttttcttgccttactgcattggctaggatttctagtacaatgttaataagaatgaagagcatggctgttcttgcttttcccccaatctttgggaagagtatttcatatttcaccatgaagcatgattttagtagtaggtttttcacagatacgctttatcagattgaggacatagttgttaatagttttgttgttgttgttttgtttttgttttttttttctggagacagtcttgctttgtcacctaggctggagtgcagtggtgcgatcttggctcactgcaacctctgcttcctggattcaagcaattctcctgcctcagcctcccgagtagctgagactacaggtgcatgctaccatgcccagctaatttttgtaattttagtagagatggagttctactatgttggccaggctggccttgaactcctaacctcaggtgatccacccgccttggcctcccagagtgttaggattacaggcatgagccatcactcccggcctgctaacagtttttcactctgaatggttactaaattttgtcaggtgcttattctgcatttatcacaataatcatacagcttttaaaatataaatccaatcctgcatttctgagatgaactctgcttagtaatcatgtattatcctttttacatatttctagatttcatttgctaatattttataaaatctttgtcacatactagtatgagaggtatatatatatggctttataaatgagttggaaagtgctccctcctcctctcttatttgagtttctgtgaacttagtattatatcttccttaaatgtttcggagaactgatcagtgaaaacatcttggtccacatagtaaccaatgtttaattaggcatattttactaggtattaatcctttgtctcatatatgttaaaatagtctcccctgtctgtcatgaaaccactagttttattatttttattttttaatatctagaatatagcatacttgagcccctttttcagttttatctttatcctttctgttgcttgtttgctactgtccagtgatacttaaccatttgcacctccctaatgtaccatactgacttcattaaatactatgatcaaatcacaaccttttgaacctattttcttacttataaaatgaaaatatcttgcagagatgtggtcagaattataagcttttcaacaaataacagctagtattatgatgatgatgatgcattattttaccctctgccttgtttaacattttactaccattaaaccacgaattatgcttcaggactcagttcccatctccctgggaagccttcgctgattgcctgactgccccttactctatgactctagagccaaatgtacatacttgtattagaacacttactgcggttattacaattatttatctgcatttcctgtcctctgatctgtgaaacacacaaatttaaacatcttgtggccccccagtactaagcatagtatttagtgctcattatttgctgaataaagagttgataaaaccaaaaacattgcattttatcttcaaagtatccttgcaagatagaaaggataagggcatctagagagactaaagctccaagaaataagcaatttgtccacattcaaaaacccagtggtggttgggggcagtggctcacacctataaccccagtattttgggaggccaaagcaggtggatcacttgaggtcaagagttcaagaccagcctggccatctctactaaaaatacaaaaattagctgagcattgtggcccacacctgtagtcccagctatttgggtggctaaggcatgagaatcgcttgagttcgggaggtggaggttgcagtgagctgagatcatgccactgcacctccggcctgggtgacagagcaagactctgtctcaaaaaaaacaaaaaaaaaaaacaaaaagacattgggactagatgccagagtttttcttcccaggttcacaaggaaggatataaaagaaatactggccaagaaactggaagactagttataggcctagatcggcatttactctcatattaaccacagaaaaatccctaaattctttatttcctcatccatagtaaggataattctactataactttaacttacagagttacgaaagctttcagatataatagggttttatgaattctaaagctccatataaaaagtattaatgtctaatgggccagtaattcacaaactttctggagcctccttcttctttgatcacccccatatcaattaactgccaagtcctatattgattgatccagcaggatctcacatatttattacctcatcttaatcactactaaactaccctcagccctcatccagtctcatcaagattactacaataatctaactgctgccctgctgatagcccaccttcagtttctgcccaagtagactatgatgtgcttctgctccacttcaaagctttcaatggctttctgctgccttttcaatacagaacaaatcccttgaactaacagtcaagctcccttaccctagattcttatctagtctcattcagcacatatatataacatacacacactcacaaactctaccttctgtgcagcctacatactagaaactcagaaattcatttttctatagcatctgtttgtgctgctacagatacgatcctggaatatctttccttcttaactccaaaacttatccaaccttttgatcttgctcaaacaatagtttgcttcaagtctatccaaatttactctccagctaaaaagtaattctccctcttgtaatttatttgaactttttttcacaagacacttaagactttctgctttctgttgttatttatgaacgtgccttctagcccttactagaagctcctttaagacaagatttatgattgattcaccattcctacaacagtggtgttcatatgtaaaactgtcaataaaaatatgttaaattaactgacactttctatctggattagctgattttacaaagctcatcctcctcctctccattgcctttcagaatctctattacttagcaaaaatattatagttttgtgtaagttgattaaactgtctataggctaagctttctatactggaactacctctaagttttcccaactctaaagcacaagctcacatttcaaaaattaaaagtacaaaaacattaaatgttagaggaaaaacaatcatactactaaattatgtaagggtaaaaaaatcaactggagaaggtgaaagtttctaacatttatctgtgcacaactcaggctgacactttgaagagaagaatgtgacagcttacaagaaaacaaactcactcattccccttaatttctgaaggctcatgaaagtctgacaggccagccacagggtgatctctcatgtgtatcgcccatgacaattatggcttcaataaaaatggtctctatttttaataaactccaactggttttcaggaaatagccaggctaacatggtcatatttaagaaggcatatttcaccaattagcagctaacttatttagttcatggacctaaataagactgtgcatggagaggtacaaaatcagtgtggtagcagagggcaaggtggtgtgaaaggctgagtccaggggtcagctgtggtgacacatacaaatggctgtgctgaggatcaccttgcccctctactttcttttggtttgatttggttttcctctttaaacagctattaagagtctccctatgaattttcaaagtgtttatgactcaaatctgggaaatactgataaaaatcacagctcattataagcatttgaaatgatttgccctaacgatagataaatgaaatataacgagtttttaaagtactctgtaattcacactggaaataacctgcagttgtccttatattaatttgacagttgcttaatatgaaataatcgggctgctatacagacactttgtttcctccccatcaaggattgccagcagaagggggaaaagaggaaaagaagtgctaagcaatgaaacctcctttcatttttagtctccactcctatggcccagctcttatcagctagtgcaggacgaaggaggaggaatgaagggagaaagagtcctcctgccaattctcaccacaaccctacttccaatctctcctaagcactgctgtgtttctagtgacagaaatctgcattagtttttcacttcagaaaacaagccatcagaggtttaaaattcacagactttctggatgtggtggaaatttccccatcatgactcctaattccaaataattaacaactagtctgggaacacaatcagtttaggaagaagatcttcatccaattcttgaaacaaaatatgcctctaatcaaaaacagtcacactattttcctacacaaacttcattaaacatgaagaatagaattgtgtaggtttataaaacatgaaggaagttcttctttaaacagtatttattgcacaatcatatcgattttcatgctaataataaacagcagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcatctctggtgtttctgttatctctcacagtgagaaataaagaataaataagaagaaaataatttttttaaaacaaatatcacaaaggattaatattcttaatatatagtctctataaaatttagtatgaaaaaaggaatctaaaaggaaatgcatgaattataaaaaaagagaacttctagattcagctccaatacataaaaggcctggaaatcatctctcccatccttacaacaagaaaaagctagaacactgaaaatcaaccagtgttccaggacctgttggagactcaagggctcagggcaaacctccacctggaaacctggagagttcagcagtctggagtcctagttgggctcagctcacctcgagcagaagccactagaaccacagactggtgggaacacttaggtggtattttgaggaattgctgggaactgagtgtggagtagaacaaaaatgagaaactctagagggctgcagtcttagaggggtcctcattttcatgggccttaagtctaggagccccacaaggtggccatggtgaagatctgagaaagatccccttgtacatcttgcagaggacagggaagtgactttctaccaaaaatacaggatggcaaaggatttttttaaaagagtaactttacagtggagaaacctggcaaacactacttgggccaggtggtcaaggtcactgtcaacagtgataagtcatgtggatagcatgttccctcgatatggtgtgatgataatggcactttactgttgtgggcttcctcccaagaacccagaccctagcacaatcatgagaaaaacatcggacataccccaactgtgggacattctacagaattcctgatcagcactccttaaaactgtcaaggtcatcaaaaataaggaaaacctaagaaacctttacagtcaagagggcctaaagagacatgaagacaaaatgtcatgtggtatcctggataggatgggaacttggaacagaaaagggacgttaagtgaaaattaaggaaatctgaatcaagtatagacttgagttaatggtaatgaatcactgctggttcattagttgtagaaaatgtgccacactaatgtaagttgttaacaataggaaaaacagggtgtagagtacatgggaacttggtaccagcttcacaataattctataaatctagaactgttataaaattaaacgtttatttttaaagtaagaaaaacatgcagtatctgaataatcaaataaatataaattaaaagtaagaggtgtaactttttttcatcaacacattcatcaaaacttgaagttcaatagtaatcaatcctggcttaggtacaataaaacatactttcctggattgctgtcagttagtataatgatttagaaagcaagctttgcaatacagttcaaaaacacactaactcagtaactctatttgtaagcatctattttaataaaataatcagaaagcagataaatgattacgtataaaattttgcatatttgcctcattaaaaattgtaaaaataagtaaaactgaaaaactaggaaaaagacatcatagcaattggtatgggagatactgccccactgggaatcatataaaagccaggctgaacacagaaaacaactgtttcctgagtttgggcagcagacaccccctggtgtggtctctgaaagaagagctcacccgagtgggtaccacctccagattggctttccccaaggatgcccttcaaagtgtaacccatggagatagagccagggagagacagtctgcttgatcaccatgcagggctcaaaattgttcaatatttgaaaatctgtcaaggaaatattttcaattagcaagttaaagaagaaaattcataggatcatttttaaagacgtgggaaatgcatttgaaaaaaatcaaaacccatttataataataactttgagctgaacaagaatggaagagaaattctttagggatgggtatatgctgaagacgctatcaaataatgcactgaaaggtgaatggttgctgtattaccactaaaggaagaaggaaggaaaagaatgtctctccccatcaccaccattaaatactcaacatatattgaaatgttcgtcaaggcaataacaccagaaatgtttacaagagatatgatattggagcaaaagatctaacgctgacaacattagcagataataccattacctaggaagtccaagggatttgtctttaaaacatactataaccaataagacgttcagtaacatctccagtaacacctgtgtgaataaaattatgacttcaattaaaaaaggaaacccaaataaatagatgtgctgtgtttctaaaggaaagacttgatattgtgaagatatacattctcccataattaacctatacatttttgagccattccaataaaaatccaaacttactatctacaaaatatgagaagctaacccaaatttcacctgagtgtgtaaaccagccagggttacagcaaattctagagcaggggagtgagtcaacaatggggcaccagatcactagatatcaaaagataaaccacaagaatcaaaacagaacagaattagccaaggaaaagacaaatcagtgaaatagaatacacagcccagaaaaaaaatattttaattcaatgactaaggaataatgaaatagctggcataggcataattgggatccacctgtgtgtcagatcaaggatggctccagagtctagatatgcctgccatcaagaggtggggtctctgcctcctccctttgaatctgggctggattttagttgctttagagtatgttggaagtgatactgtgccagctccagtccaagtctttaaggcaacagcagattctgtttcctttctctggtagccctgtgctgtcctgtgggaagtctgattgtcctgagttggccatgctgtgaggaagcccaggcttgccattggtggggggccatggggagggagaaaggggaagttgaggggccagcccatgactccttcctcctccatcccagctgagtgccccaacattgtggaccaaaagcaagtcattgctgctgtgccctgtcccaattcttaatccacagaatcatgtgaagtaatggttgtaaattattggcttgagggtaaaccaaattaggggatagtttgtcatgcagtaatagctaaccagaacaacttaggggaaaaataagttagactctctttctacactataaataagttccaaagggatttaaatatataacttacaaagcaataaagtactagaataaaactaagaagactgatagtttaccttgctaggaggtgtagaaaaggcaatttcatacattgttagtggtagtgtgaattgctacaactttttggagagtgatacacaatatctattaaaattatcaattctgagaatctagctatggaaaccaagttcaagttcttatcaatatataagactctctgtaagaagatgcctatcacagcatagttataaaaaaaacaatgaaacagtttggatggtggaatcaattgcatcctatccacacaatggaatgttatggagctattaaaaacaaaaatgctagatctatgcttatgaacctggagggattttgtcttattcagtttgggctgctataacaaatataccccatagatgggtgttttaaacaacacacacttgtttctcacatttctagaagctggaaagtccaagatcaaggtgctggtagatgtggtgtctggtaagattagacagacaccttctcattgtatcctcgcacggccaagagaaaaatctctctcctcataagggtcctaatcctattcctgatggctcaaccttcatgatctaactacttccccaaagccccacctcctgagaccatcacactggaagtttgaatttcagcatatgaattttggggagatacaaacatttagtccaaaacagatctcaaaaattaatttaaaagtagtttcacactctggaagatgatttggcaagttgttaacaaataaacatgcaattatcatatgacccggaaacttcattcttggattttttttcctgagagaaataaaacttgtgttatcacaaaaacttgtacacaaaggttcataaaagctttattcaaaatagccctaaaatgaaagccaggctagatgtcctttaacaggagaatactaaacaaactgatgaatccatggaatgctactaaacaatgaaaaggaacgaaatattaatacacacagtaaataacctggatgagtcagcaaagaattgtgctgaatgaaaaaagccagtcccaaaagattatatactgtatgctccatctgcacgacattttgaaataacgaagctgtagaaatagagaacagattaatggttgttggggattagagattggaggaaggtggacgaatgtgtgtgtgaggaaggggacaagaagaaggtgaggagtaatgaaaaggcaacaagagggtccctatggtgatgaattgttctgtatcttgactgtgatggtggccacaggagcctacacatgtaatgaagtagtgcagaaatacacgtgtgcgtgcgcgtgcacacacacacacacacacacacaagagtacaagtaaaaccagggataacatcaatggattgcatcactgtcactatcctagatgtaattttctactacagcttcacacaatgttatcctcggaggaaactaggtaaagatacacaagaactctatattatttttcacaacttggaagtgaatctatagttaaccaaataaaaatctaaattaaaaaccttttaaaaatattataacaaaatctataatacagtaaaaaagtagctttcagaggtatttaaatatcatcttcccattttggtaaaacaagacaaaatgaaacttcatatatttgaatatatatttgaatgagcacaaggtgtgatagacagagctcaaactattaacactggttacctatggaagccgggatggaggagaaaagaaatgacattatcaagttatcaagatgacattatcgacatattctatgttgacttttttttgctacattaggatgcatttttataataaaaataaatattggaaagagctaaatgaaaaaacaaaaccataaaagtgatagggaaaataatatattatttttacaagtttagggtggagattccctttccaaggaaggaagattcaacacccagaagccataaaggaaacaactaacagattcatctcataaaaaaataaaaactcccacagatcaaaacacatcataaagaaagtttaaaaacaagtaacgtggaattttctaacaaacgaaagattagtagccaaaaattgtccttacaaatcacaaagagaaaacaatgaaatagaaaaattggtgaagactttggccagaccactaggataaagcaataatgttgactgctaaaacagaaatctttcagccttggtttggcctgagactctgaaagtcaagaacaagacagcaggtgccaactagccccagcgtctacatgctggaccccgatgcaagacctgctcagaggatgatctaaccctccacctcttacccaaaggagaggcagagggagacagggcttcttgtgaagagttggcagtggcccccgaggttccttggagacacacatgggcacacacacgcatgcacactcagacacacacggaggaggaaggcaatctgcttctcagcccatgccagagggcagtcacactgtgagaggaactccaagatgggtcaccaggagaatgtgacatgcgtccctccaaagactgaaggtgagggtacgtggctatgtctgctctgcccaagctggcacaaggggaagcaaaggacagtgaagagaggggaaggacctagggcatctaggccccaaattacaggctgatggtggcactacgagtggccccagtgaaaggccttccctctgtcaagaaaaggacaatctgggtccacagtggattgggccttcatcagcccccaaagcatcattcaaagagagcatcagaaattgcacccagaagtctgaaaaaccccaagctgtatgacatcagccactttgtggccttttttcctaatcctttctccttcctgagtccagcttaagaaggataataagcagttcctgttgagttgggggaaaagaagggtgagaacagctgagtttctctaggcagctcctgctggaggctggggaagctttcactgggatgagagcccagagtcagatttacgctggtcctgactgtgctgtgcggtcctgacagtgctgtgcgatcctagactgaccgactagactgagccactgaaaatttagtgggagttgccccagattttattgaacagcagggaaggaaaaccaggagagcagattggaaagggcaatagtgagaactacagaagcggtcctccacttggcccccggtgaagtcccctggatcctgtccagaaaggtcctcctcaccagcaatcaaaaaaacacaaattaagacaaaaatatgtttctctcgattcagaggggcaaatatgcaacatgccaatgtggtctcaggatggtgaggaaattgctcatgcatcactgaagagcctgggagtgcaaaaactccctccagaaggcaaaatgcagatttgctgaaactaaacttacactttacaaaaatcccacttctaggaatatgttctaaaacatctcttgtatgtgcataaagttgaatatagattcattgcctcattagaaaagtgcaaatttagaacaatctacgtttccatcaataagggtggctaaacaatcatatgaagaaagctctacatcactgatcattacagaaatgcaaatcaaaaccacaatgagataccatctcacaccagtaagaatggctattaaaaacaaaaaagaaaacagatgctggctaggctgtggggaaaaaggaacgcttatacactgttggtgggagtataaattagttcaaccaatgttgaagataatgtgacaattcctcaaagacctaaacaaagaaataccattcaacccagcaatctcattacagggtgtatgcccagagcaatataaataattctgttataaaggcacatgcacatgtatgttcattgcagcactatccacaatagcaaaaacatggaatcaatccaaatggccatcaaatggtagactggataaagaaaatgtggtacgtatataccatggaatactctgaagccataaacaagaaggagatcatgtcctttgcagggacatagatggagctggaggtcattatcctaagcaaactaatgcaggaacagaaaaccaaatactgcatgttctcacttataagtgggaggtaaataatgagaacacatggacacatagaagggaacaacacacactgggcctgtcagagggtcggagggaagagggagaggatcaagaaaaataactaatggatactaggcttaccacaagggtaatgaaatgatctgtacaacaaacccccatgacacatgtttacctatgcaacaaacctgtacattctgcacttgtactcctgaacttaaaagttaaaaacacacacacacacaaacaaaacacgatgactgcatacacacacagaataagatgcagctggtaaaaagaatggctctatcttctgatataaaaaagtctccaagacacaggaagtggcaaaagcaaatcacagaattgtatccaatgtatgacactccttacattaaaaagcaaatataggccggccacagtgacttacgcctgtaatcccagcacttttgggagggcggatcatgaggtcaggagatcaagaccatcctggctaacacggtgaaaccccgtctctactaaaaaatacaaaaaattagcccggcgtggtggcgggcccctgtagtcccagctacttgggaggctgaggcaagagaatggcgtgaaccccggaggtggagcttgaagtgagcgaagatcatgccactgcactccagcctgggtgacagagcaagactccgtctcaaacaaaacaaaaaaaaaagcaaatatatatgtatgcgtgtgtgtatgtatttatatattcatacatatataaatatgtaaaaaataattagagaattctcatcaaaatgttgccagtggttacctctgggaaggtagtggttacctttgggagggtagtgggtacatgtgaggagaggttttttgtttttttgtgttttttggagacagggtctcagtctgtcacccaggctggagtgcagtggtgtgatctcagctcactgcaacctctgcctcctgggttcaagtgattctcgtgcctcagccgcctgagtagctgggattacaggcatgtgccaccatgcccagctcatttttttgtatttttagtagagacagggtttcaccatgttagccaggcaagtcttgaactcccaaccccaaatgatccacctgcctcagtctcccaaagtgctgggaccacaggtgtgagccaccacacccgcctcacgttttttattgagtaaacttcactgctatatgaatcttttgtaatgacaatgtatttatatatgtgtatggtcaatgttaataaaggttagagaagttaaaaatgaagaaagagtactgtggaggatggagtggatgaagggaaaagccaatcagagaagcaccctagggtgctgtagcagtagtccaggggacacctgtgaaggctggaattagacatgggcacgggaggagaagggggagcaggtgagcatgggcttaagaggacaactggcacagtttgttgactgtggacatgcgggctgagaggaagaaaatagattaatgtgatgactaatgtagctgatgacaactgtcccacacttcgagcaggggcccagggcaaggagcagggtggggaaggaagcagaggtgagagttcatatcccaggggatacacttctggcccatcagacagtggagtgtgtgggcacacacctcaggcggcagatcttggagattccaatttgtatttctgaacatgtaagtggctttgagcatgatcaaggtgaacaagaatagaaatatggaaggcaccaacagatgatggacagatgaggaaggagatgataactacagcaaaaaggccaaccacaggagaggctgccatttgttgagcaagtgagatatgctgtgtgctgtccctttattttattcaatcattataataatgggaggtgggttttatcatgattcccattttataaatgagcaattggaagcttagaatcaccaaataattttcccaacatagcaaagaatccagctctggctgactccacactcacagcaactacaccacttcgcttctgccgaagcaatcctacttgcactcctccttttggattgctgagaagcatcactatctaattaccataaagccccctcctctccatgcctgctatctttgtcctggtttgagacctctttatccctcccatccctaccttcagtctatcctgcacaggactgacaaagtcatcttccagaatcacaagcatgactacatcagtattctacttaaaatccttcagtaagtattctctctaccagtcgagatgctcgagcaaggaacagagagatactattgtctgaaacaaccacaaagacaacaaaacacatgaaacaatgggtttcttttttatttgtttttgtttttcagcttatattttagattcaggggtaaggaaggattttacctgaagccttagcgggagcatggaccttgagaccttgagtttggacttccagccttcagaactgagagggaatgcattcctgttgtcttaagccacgcagtttatgattctttgtgacagcagccctaggaaactattacaataggtttatagatttcatcagacttggaaaatatttgaccattagttcttcagttctttttctttctcaccctctcttttgctcctctgaggactcaaatgacctgtaaattaggccactttaaattgtcccacagttcactgatgctctgggagtcttttaaagacttttttttttttttttgagatggagcgtcactcttgtcacccaggctggagtgccgtggtgcaatcgcggctcactgcaacctctgcctcccaggttcaagtgattctcctgcctcagcctcccaagtagctgggattacaagtgcctgccaccacacccagctaatttttgtatttttagtagagatggggatttcaccatgttggccaggctgatcttgaactcctgacctcaagtgatccaccccttcttggcctcccaaagtgttgggattgcaggcctggaccactgcacctggcccaaagactttttaaaattttctttctgtgatttctattgctacgtcttcaagatcaccagtctcttgtgatgcctaatctgatattaactccatcgtgtgtattttaaatcttatatattgtcttttgtttggatcttttaaatatcttccatgtctgtacttaactttttgaacatgtggaatgcagttataataacagttttactgtccatgtttactaattgtaacatccatgtcagttttgcatcagtttcaattgattaactgtctctcattatgggttgcatttttttgcttctttttttattcactgctagacattatgaattttaccttgtttggtgctagctacttttgtaatcctatgcatattcttgagctttttatatgcagttgaattaactgaaaatcgtttgatcccttcaagtcttgctttcaaattttattaggcaggacaagagctgggtttagtgtaggactaatgatagccacactcatgaggcaagaccttttgagtactcaatgcccatgaattgggaagttctccagtctgtctggtggagacaggtgttgttcctggcagcactccattctctgcctttgtcatcacatgatgtttgtgtctcctcttcttgtgtacaagaacaccagtcatatcaaattagggttctccctaatgacctcattttaactggagaaaccttaactgattgctttctgcagccaaccagaggtaccttcaattttccatttgccacagagaaaaggggaaagatttgcaaagggagcagccttgagtccttttgttactgaggcatggaaagttggggttttcctctcaatttagttctaggaagtcagtgtgaattgatcttagattccctgcctccagaccctgttctcctgcctcaataggagagaaaagctacaacaataagtgaatccgcccaggagatccataattgaaaaagttttagaaaagagaacagagaaagtatatggagtgggggtcagtaattaaagaaaacaataaaataaaatgtatcagattttgcataatgatcatcagcctctagtgtgaaaagacccactgaataacccctaagtgaaatgagatccacgccaaccagagcactccccggataaaagagaaaatcccgaaatatttcagagagggatctggccttgtatgaaagaagaggggtgagaacggtgtctgacttctggtggcagctctgtgagccagaagttagtggccatggcttcaaattctaggtcaagaatctccgaccaagctgccaatcaaacatgaaggtagaataactaatttttgcacatacaagctctcaaaacatttcccagtacaaaacattcttcagaaagctatagagagggaaaaaaacaagagaggacccatctttcagcaactagagacccagcgcagggaaggcaaaggggactcccagaaccccaagacaaccgttggaccaccacgtgtgctggggcaggggcctgggaggatgtcgctaggagaggaagcccagccatgatgcatctgcaccactgcaaagagagcccccttctggcccagagtctagggatgagtgggaagacagcactaaaccaagggaaatcttggcaactgtttattccaagtaaaacaaaaagttgtacaaaataggaaatgtgcactgcatggtttagctgtgaataatacgaacatagtcataactatgtaaataccaaatattgatttggccaaaaattaggctgtaactaccatgatggggttgagacaaacagagagacagcacgtatgcacaggaggatggtgtttttaaagagcgacatcctcctcttccatggtggaagttcatcccgtgacatttaaactggaaaatcaagaaatggccttctaaacttgttattttaaagtcaggaggaaagcaccagaagaaacggcaggaattcaaagtgattgcctctggggaacgggaatctggagtgggaagaggaacgctgtttctcattacaaaccttgaagaaccatttaagttttaaaactacatacatatatgactctgataaacatacatttttaaaactacttacaaaacagcaaggaaaagattaagaagggtgaaggcagcacatttcagactgtttcagcgacttacctccaagtgagtaaatacataactcagtctatgccatttaggcatagacctaaaggggtggcatccagaaatttcttcaaagtcttacttattatctttaaaattcaggcagaagtttttactctctttcataatacatccctgtttgtttttatagtatgtggcatacctggcagaaggttttcttttcctctccttttgccttctttctctttcctgagacacacatcaggctgggatgacagagaaagacattctttcagtagaataaggtatagagggtgcccgtaggattaactgggaagggtgaaatatctgataatttttcagtcattacggactagtactaccaaggccccttatagcatctgctcaccccactgtctaagcctggtgtctctgagcagggaactcagggagcttgaagactggacccccagcacaaggccagggtgggaccctcttgggatcaggcggcagacaaagccctggaggaggggaaggagatggagtccaagaaggaaaagacatctcagtcttagcatcagaaagaccatggggttgctcccaaagagttagacctaaagccccacagcagagaaggaatctgggaaggtgggcttcaaggaagaaagtggagaatcccatcccaattctccaactcctcttgtgaattctggaatcagtacagttgttatactcacagcaaacatcgttcagggtcttcttgcacaacagagctttcaaaaatatgctgtgatttcatcagtttcctttattggccactgatatgcaaagtctatcctgaggctcaggatcccccaagttctcccaaagaccctcgggccccagtctaggaagcatggagatgacaagtggaaaacagtggcatcacacatgggacagatgatgtgaagttggcaggaaaattccctgggatacgacttttgtgggggtctctccacgtcctgccctgttggaggctggaagcctctgtgctctctacctcctgggggggcagcagggcagaaaacagaaggttctcagagagtacccctgttcctagctcttgttcttcaaacgtcaggaagtgtgttgggaagaagaaagaagttagctgcagaagccgggagggaaagaggaaagattgtgcagccatcgagggaggcaaagtccatggctcctggaggagagaccctgcctggctagctgtcggtgctgaggaaagcaacttctgaaagcaactgctagagggaggcatggaatttccactcctgtgcaggttgctgtgaccttggggtccagatgcacggtgcccctggccttgaggagaccaggtaggctgtgttctccacattatagccctaacgggtgggttggaggacttgcttgctgctcttgtgggaccttcataagcccaggattcaaaaggaaccttcaatataactgagactgaattatttccagccaggcagaagtgccagaaattcaaagagtatttgggaagcaaggcatatgcctgccgcttaagttattcttgttgttttgaattatgaactcctttgcttcaggtgatgccccatctggcctggcatccaaggcaggtgagaatttcctccaccaggctttgcttggcctgggatgaggaattcgactggaatcacactcactccaccttcccacatccagacacaagcagtcacctttagggttttgcctctctctgttccagacagctggttccagagtcagctgtcacaactgaccctgacagctctagggagaattagcaaggcagaggaagggagtccttggacagagaggagggtggacaaggaagagaggagactttagagacaggcacatcccacaacctccggtgttaccatatccagcaggctgactgagccgcactgagccctgggcagaagtgggtgatctctgagctggggctgggtttcatttttcttgtctctctgagctcagccaccaggcgatacccaagttagtataccccacccacactgtggccgtgtcccagtgctccaaacgccacattgaagggagctggtctcagactgcagagctcacatgtgacagacataaccaatggggaagaaagagtcgtcccctcatgagtctgaagccagtacctaaaggagagaatggggaggcggcaaggcatggccccacagcagaggtcggaaggaagagctcccagggttaagaagcgaagccccgagacacagccaccattcccaccaccccagctcagggctacctttgggacccacccaaaactcagctaaggccagggaggaggggtcctcaaggacaagctgcaggcaccaagccctgccatcaggcactggccagactggagtgagaagccctgtgagcacatactcgctcctctacttgttggtcttggttttacgtgtcaaccgaggaaacagggccagtgtgtgcaatcgcctatggttggaggcgtggtggaaggcgagccccttctccccaggctttctgaaaccatgtgggagatctctaccagagtgacactgcctgcctcccatccccaccccccactgctggtggcgatgggacagtccagagtcctagtttgggtaggacagaaccatagaaaggcaaccccccactccggagtctcattccctcctctctgggtcactttgacagtcttgcctgctccagcattctctcggggctgtcggaaaagtgacagggagtgggcacagggttagggaggtgagtgtgggcctgctgctccatcggcagtgccgtgaggaagctgctgctccttctccagttctccatctcctgcatttcacttctcagctagatgtaagtggagaagaggaataatggggtgttatttatgagtcccttaaaacctcaacaaccctaccatgtgtcagacgaggtgcctggagctttgtcaatccctcgtgtcattttgtgccataactctccaggcgggaattatcaccctgtgcatgtgagcctcagtctctgccattcccacccctgcgctctttcctccacactgcaaagtccccatcggtaggagtacacttgtctctcagggcttgggtgagaagccctgggaacctcatttggtgggaagcttttgtcagctgcagagcatcaagcaagccttgggctctagattttgctgtgcctcgcattgctgataatccaatggtgtcttgcctccagctcccgaagtccacagatgtggcagcgatcatggccctgttccctgctctcctcagcccacacgttccccttagatgacttcatcggccacaaggctccaattaccggctctctgctcagatttatgtctcccgcccaggctgtgtgcagggatccaggtgcacacatccaatcctgtgcacacctccctcagccgtctgacagctgccgaagctcccaggtctacatccacttgacatctgcttctccagatctgctcctccagggtcctccagaacatggtactgtccttagacactggcccctctctcaacacccgtgtccaatcaggctctgagtcagggtaggtcaaactgagaactcctggccctgttcacatctctctctgcaaaggccaacatggtttctttgcccgggttatgtgctagcacctaaactagtcttccattcccaccttggccccatcaaatccattctgtgtactacccaatataatagttcttagacacaaatctgatcatgtcacacagtcgtttaaagcccttcaaatcctcccagtgcatttggagggaaactggatggctgacgggggcccaggcactacagggctggcttctgccccttcttcagaactccagccacagaagtctcctttttgttctcagaagcaccggctctttcccatcaaggctcccacacgtgtgtccctctgcacggcctctcattcccacactttgctcagccaactgcggccaccttcagtctcagatggcattagatggcacttctgcagggaagcccatcgccctccagattgacctgagaccccccgctctctggaatacaggaagactgaaaaaaccttactgtgttttgaactgtaatgtgctgtttacacttgtgtaatgactttcttccgtgagggattatggtgccttgaatacagaaatcagggcagcctgtttctcaactgtgtcctcagggccttgggcaggtctagcatgaagcagggattagtaaacatcaatggaatagattccatggaagaggctattaaaataagttgcaaaatactgaatatattggtttttttagtcaactataattttagagcacctgtaggttcacagcaaaaactacagagatttcccttataccctctgccccacacatgcaccgcctcccccattatcaacatctcccgccagagtggtgcatttgttacaattgatgagcctacagtgacacaccagtatcacccagagtccatgattaatttgagtttactcttggtgttgcacattttatgggggttaataatgtcatgtatccaccattgtgtcaagtgagggaagagggccagtgtgtgccatcacctatcattggaggcatggtggaggatgagccccttctcaggctttctgaggccacgtggggagacctccaccagagtgacactgcctgcctcccatccccaccccccactgatggtggtgacagcacggtccacagtcctagtttgggtggaacagggccatagaaaggcagcagctccccaccccgaagtctcattccctcctttctgggtgagtttgacagtcctgccatccccggcactctctcaatggtatccacatcgtagtatcacacagaatagcttcatggccctaaaaaacctctgtgctctgccgatgcacccctctgtccccccaacccctggcaaccactgatcttttaattgtctccatagttttgccttttccagaatgtcatatagttagaatcatacagtgtgtagccttttcagagtggcctttttcacttagcaatatgcatttaagtttcccccatgtctttccatgtcttgacagctcattgctttttagcactgaatcatattccatgtgcctggatgtgccacagtttatccattcacctactgaaggacaatttgatgcttccaagttttggcagttatgaagaaaactgcaataaacattagttttgggggtgctggttgtgtggacataagttttcaactctttggggaaaatgccaaggagtgtgactgctggatcctatggtaagagtatgcttagtttttaaagaaatgtcaaactgtcttccaaaggaaactgtaccacgtttcattcccaccaacaaatgagagcattgttgcttcacatcctcccaacattggtgtttcccgggctttggattgtgttcattgtactggtatatagttggatcctgttttaatttgcaactccataatgacatatgacattgagcatctattcaaacacttatttgccaacttgtatcttctttggtgaggtgtccgttcacgtcttttgcccattttttaaatcaggttgttcgttttcttattgagtttaagagttacttgtatattttaggtgatagtcctttgtaagatgtgtttttttcaaatttttctcccagtctgtggtttgttttctcactatttcgaattatattgacttgacttaaggacaaaaacaaccctattttaaagagtttgtaatgagaatgagtacagcaccttcttcctagatctagaagcagtgcacagctgtggtttcctaggctttcctggccattagatgtgggtttgtcaggagcccacactggcctgctaagctgtggccactagtcccacgtctcctgggctagctgtactcttttgaagccagtgcctagactaatgctttggggtagaaaggccgaaagtcctctcactagagactccacctgacaggcctctctctccagggaggaggtggtggtgcctcaaagaagaggaattcccactcttggtcattctagcaagggacaggaaatgagattagtgactgggtgaggcacagggacttatttggagcattctcagggaaggggaaggcaatcttactccctgacagtgagggaggtcatgggagaggcagccaggaagcccccttgttccggtccagggagctcacccctgacagaggcagctgagagttgatatgcctgggttgatgactcttgcacccatttaatttaaaggataaaggtaggctgcagtgctttggggccaggccacttggttttgtgctcctttcaggttttttccacggggactgttgtgcatctcacagcactccacgtgcctaagactgcaattgtgggtgcatgaggaagacagagcccctccaactcttcctgcccagccgttggtgagaacagagccagagctggagctgcaggagaccttggtgcagtgcccagtgcacactgccctacctgacaattctgttgggatctgggggacagccaggatccagaggggctggaggaacagaacaaggccctggacataggctggccacagagcaagcgcagccaaagaggaagtgctgtgcctggtttctttccgccctccctcctccttcttccctgttaactgttctgctgggagcctccggatcatggattagggattgtggtgggaccctgtcagactcaccatgttgaagcaggtcaccaaaggtcacacagttgcccaggatgagaatgcctgtgcccaggggtgcatcaggtagagtgaggagctgggattggatcccttggccaggctgctgcttctgcaattatccagctaccgtaggacaggaataaaagaagccacagaaatcaaagagctgaggtaagcaggaaggcagggcgagaagggagggcccaaaacagcctttccccaaaacagactttgctcatgatgatgggaactgtcgagtcttttgagggaccaaaagggggacacagtagcagagctgaagggccttgtcctccaggaatcaggaaggaaaggaaactaaggcagccagagtttatgggtcagtgctgggccccaaagcccaaccgtgcaaagggttttggctccacctccagcaaaatgatgtctgatgatgtgtcccaggatggggtctctgccagccctcctactcattgatgctcaccctgcacccagaaccactcaagaagcagcgggggtgggatgaacctccaggatgcctgcaggtggggcagattcaggggtgaaattcagaactgatataagaaatagatttaccttgaagctaatgatgcttccagcacaggcctctcatttgtaggaaccccttccaaagccccaggagtggctctagcaatcaatgtaagtaagaagataacctctcattctactgggacctcccctgtgtcccacacaatgcactctgcccccatcaggtggcactggagtggccccaggcatatgggggatccagagaggttcagctgagaatatgttatttaatctataatctggaaagatgctttgaaaagttgcaataaaacaaatgagaagttatggtcttccactttggacagaaatatgattttgtcatccttaaatttttaattaaggaacagagaaaaaaattagataatgattaatggggccaggcatggtggctctcacctttaatctaagcactttgggaggctgaggtgggaagatcacttgagctcagaatgttgaggctacagtgagctatgatcacaccactacactccagccagggtgacagagcaagaccctgtctcaaaaaaaaaaaaaaaaaggaaaggaaaaaagaaagaaagaatttactgttaataaaattatgtttttaaatgttcatattttaccatgaagaagtagaaataaatgcctaataaaaataataatcaggctcttggaatatttagtaatctaatcaagagaagtgagtcctatgaagacattggggaaacttttaaatttattgatgaattaatcaaaactgacaaaaacaaagaagacactaaacatgaataccattaaaatgtgggtctagaagtgtatttgtcattcagagagcatttcaggtcagtcaccatacagaaaatttgacatgccctaaagtcatacagctcagatgggatagaaacatggttcaagtcttccctaattttttcaacaatttattataatttatatgacattatcaattcatcatgaagttgaaataaatttttctcaactaccgattttttcagaaaatgttgtttgaccagcactgccagaggaaagactgaaattacctttctattatgactctagaaaatcattgtcatatgaagagggaaacagcaagtacctagccaaaaatacaagaaggaaaatattacacagtatgtctggaagccagtaaataatatgtttttgcagagttttgtgatgtttacattatttatcagcttttaaaaaatgtgtagttcattttaattcttgtatcattttgaataagtattcacttttacacctagttttgtactcacaattttgttatcctttttctttacaaagtcccctacatttaatatggaatcgtagaaactagatggactgtgacagaggtggtgaccaggcatgggtgcagacacaaactctgcacggcctcagtcaccttagcccagaagccacctctaggccctgggacaaagagccaacctaaccacccgcaggcgtgcagccctactggcaggcactagctctccatcccccgacacctccccatggctcaggcgcccctgattcaaatggggaatggactggcatctggtcactagatatctcgtccccagattaacttttgagtcatttccaatcctgttcttttttaaagactgatggtgtgtactttcacactcctggaaagcaaataacatgagtttctggaggacaaactggcaatacatattcaaagtattcatactctttggcctggcaatcccccttacaggaatctatgaataggaatgatcagaaaaacagacaaatatgtaagcaaaataaggttcccacagcattgcatgacacaataccaacagtgttaacagaaagaaaatccttctgttatgtctctcccttgtcactaggtatccacagcctgaagaaatttaccaacatattaactaaaatgctctgagtggtacaattcggaggatggttgttttcttctttatgcattttgtgtgtgtgtgtaacacagatgagtttatcagaagaaaatgcacttttaaaatgaaacagtcgtagaaggaaatcaatcagacacctaaattaggaggctgacacaactgctcccaaaggaatgtcttagtacccctcagtatttctttaaaataaatggcttcagaaggctaaaaaatgggcctgcccacctcttttctcagggatccctagagcctttgctcagacactttgattcagtaatgctcataaatatggagcggccctttgcaagatcccttgcattttaatgtgggggtagtgctcacctcctccgtggatgggtgattgcaagcagtttcttggtcctcatttctgcaagagccagtgaggtgtgtggactgggatacttaagaaggagacacatggaaatgccatcttctgaccagggagtcccttggaccttggaagcaaccagagagcagagaaagaacagtagcccatgcagatgaacttacctccctcttctggccttgctgttgtcttctgtcaagtggggagatgactctgagtaatctctgagggctctccaattctgcacatgagcttcctacgagcagggaagttgactggcatggtggctcatgtgaaggccatggggaggacagggagttcacccgatccagcgcggatgcccttccttcatcttagcttgggcgggttagtatttctcatcctgaagtcaagctacctattctggtctcctggagtctcttctgacacaaggctaagttatgtaaatacacaaactaaacatgctttgcaggcataattttttaaacagagatgaggaatagagaaataaccaaaaaaattatgtacctttctgtgcctggtttatgtctgatttcacagaatccagcagactgtatacacatgggacaagcctgtgaacttggctatcacctctgagtttcagagggtgggtgacagacaaagacaggctggcgccacaacccagcacagcctgcagaggacacctacacatggggactcggtgtgggtcttggtggcacaggggagtctacattggccaggggagccctggggcccaatctcaggaagggatgtgccgcagggaaaatggagggccagaggagatcaaggtagagatttgtttctgtgtacggtgcagagagaggtccccaggtacaagccaagatgtcacaagtgcagggtgggtgaaaggcatctcagaggccacctgcagggaaggatccctactgacctgggcacctgaacacagtgtagcctgcaaacccgtcctccccagaggctctgcacccacacactctctgatctccctcatctggacttttataccaaagaggttttgatgcgcctatcagcttgccaaggccactgacagccacagaaatgcggtggagccaaccccatccaggggtcagtctttgatcctatttattatttagaccagtttgtgacttggtcaatacagatgctgcatagccaggaagcactgggtgcaggcttcgagctcattcccacagatttagtggtcagagaggaaagggcaacaccttggagaagcttgggaaattgaggcccaagagatgaagtccaggggattaactcgctcagcctcaactggcaaaatcaaatttggaagcagctagaaaaccacattgtgaataatgtagtctggcttggccccccacattgccttgtcgtgggcttccaaaccatccacttggaagtgccccatcaccagcctctaatgaaatgcaattggtgttcccgaccacgttcctaccttcaccagtcccagcagcccctcagtcccggccgcacacacttgggcacgccatgccagctgcaccaagccaatctgctgtgagatgccgggaaacggtttgcaaatattactttccaaatttatcacacttggcctggtaccgtggaaaaagttggttttgattttactgtggatgatcctgaggccccagtctgtgtcctactggggctggcttcgggtgctggggccgaagcctggtctcagagaggggccgggccttctcaagtggttctgctgccgagaaaggtgccagcccctccactgaccactggccacctgcagaagcccacctggctacactggccctttcctggcactttccaagccagcgaaggtgacctccctctggcaaacagaaatctgcgctgttgggagacagagcagtaggcatctatctccacatagctatcttgagcacctggtatgcaccattttgttagcatggaactctctccctatccctatctcagcagcttccttggagccagcagcaggcctgaggaggaggagaggggagtggccatccagctgtcaagatagaatccacaggccccataggagggacctggctgcccatcatagacactcagtctctcgctctgtggctgtcaagctcccaatatttctgtctctctcttcttttctgtctttatctgtatctttctctgtgtcttcttctctctctgtctctgtctccctctctgtttatccttctctatatctctgtctctgtctgtctctgtctctctctccctctttccctcctctccctctctttttctctctccttcctccccctttccttgcatttccctggggatgatggagttttcctccacgtcaccatgtggctagacaaatcagccctggcctttttgctcttgcatgagagtagaaggcctcccaaagcccctcaggttccatggtgtctgctccagccaggccccccaccaaaaccctctgaatcactggctctggggatggcaagagccctctttccctggtcctcacactcagtcccagactgttgagactaatgaccttgagtgtgtgtcacgtccctcatgtccccctctagggaaactggccagagtgggaaatcacagccagattttgggtcatgggcaaggggctgagggctcatgtctgtgaagagaggggcctcgaggggcccaggcagggaatggcagtgccgggagcactatggagagtggtggggtctgcaggaacctgccaccaactagattgggcagccgctctcctgccgcacgtctcctttcacatctgtggccagagtctccaacttttcaggagaaactgcagatctagattttcatatgaaaatgttaagacataattcaaagttttttgagaagcactctgcaagccaaataaaacacatcagcaggacggatctggccagcacagcacattcatgacctctgtttggtgtcccctaacacccacccctgggccccagccaccttcagggctggcaggggggcctctgcttccagggcccatgctcctccctcgccttcatcctggtcatggggctctgccttccccggagctgtcccagtgttcagatgaccctgaggcaggagcccacctgcagtacagcctccaggctggtcagccggtgtagacatctggtcattcttcatgtctgtcacctgcccagctggtcacaaagcagaggtccgagccccaggaaacccaggaccaccaggctgtggaggagaaagacttgctggtgtttcatggcccttgtttgctgttaccaaagctcatgtttaaacacaattactttctgctccactcaggcaacccagttggcacacccttccagggaccaagtcccatggcctttaaggaagccctagcatggggctgcccattccccagacatgaaaggcagctagtaagtttgctactcattagctgtgtggcctgggaaaatgacttagtttggctggcctcagtttcttcatctgtaaaatgggaacactatctcatgctagataaaaaaggacaaaattagacaaattagataaattccctcccagcttcacccatgtgcagaaatccttgaagaaggagaaggcgaaggagaaggagaaggagaaggagaggagaaaggggaattaatatttgttgaacctattatgcatgaggcaccttgacaagggcttacaaatgtcatctcaactcaccctatgaatcaccctggcaggctatcaccccacttcacacagcccctatttccacttcacagatgaaatcctgagctccaggtaagttgagctatttgtccccggaagggcccaagatttgaaccaagattcaaatttggtcggtctcaacattaaacctagaaacccggccagctgcagtaacccccctgcagtgccttcagcctctggccctggaccgacactccctcccatggctccaacatgtgtgggcccaggctccagcgccctcctcaggggctgccctgcctctgctcttgagaggacctgcaggcctccatcacccagcccacgcttcctgtctgtgttgcaggggtgcccaacccagtgctggcctcttcctctcggtgttgcaggcggcctgccaatgccattccttgactcaaatggactctgtggacaaaagaacactcccccaactactgccttcttggcccaggcaactccttctcatccttcagaacccagttcagacatacctcgtattgggggctgtgcctggcaaccccagctccccaggctgggctgaatgcctccctaggccacaccagcacccaccttggccttgatctcattcactatcagtgagtccactctgcagtgaggggcaacgctgagctgaggtaaggcagctctcctggggccactgccttaacctgagggtcccagcagctgtccctggggcccctggtccttgcctctgatgccaccctgtgctgctgttacccactctcaagcaaaccacaccctggtgggaggccctggggcggcagaggctgtgaggacagagcctgaagcctctgctggggtcccaccctgagctctgaaagaacccccaaatggaagcccccaccctctgtgttgcactttgcttttcccatgtggccacaggtcccaggttggggactgggccaccttcccttcctcttgctttagtttcatgcccagctccgggtgtcttctcgtcggggactctgcatgcctttctcagggctgagcagagctgaggggtccaggagccctggttacccccaggtgacatcccgtggtattgttagcatggaggtgatgtagtgaagacgggttgtcagctaggatgggggcgagatgaccatctaagcaatgtcagagcagggcacgtactcaaaaatgtacaaacgtatcttccaatcttccagctgttgggagagcttgggccacccaagggcacagcgccccctgctggccatgacgatgatgcggcttagctcacagggctttcctctgcagcagctccccagaagccaggcaggggagtgctgggcggggtgggagagggataggggtgtgcatgcatgggccatttctcattctctaacatacaaacgtgctctgacacctctcttgaggaccccctgtgcccactggcaccaccaacaaatcaatcacatagccaatcaacaaattaacaagcacctgcagtgtgcacacactggcccagactcaccttacctggatgctccccacctccactctctgtgttcaatttgccatagtcctcctgccccacctcccatggctctcacccccacagaactgccccttgtgccttcctcctcaaccaggtcctcacgcccccaacaggacacatacccagggcccaaccacgtggcctatctctgcactctcctgcacccatccatcccgcacaccacccacactccagtactcttgccaagaatgctcgagcattctcaccaccagctccacaacctccagggcttccctgtccttgagaaagagcccagggaaaggcttgggtgatcagacccaacctgcagacgcagccctgcctgcctgactcccactcaatctgccctctaagcaaactgcagcagcacagcaccattcccagaaagcacccttcacagcagcctcccacacatcttcacagccccccacctgcacaggcatactcagcctcacagagtccccctacagccctgacccctcgttcctatggaagactcacgccgaggccctcgtccattcccattgcacatggacccaccaggccactcacctcttcatctgagcccccacacccagaagcacccatgccccaacaccctctgtggtatccaccctcccgcccacactcagggttctgtacagaaaggagggatgcagggagtgtggtgagcataggccccgacgcccagtttccccagagaagcctttcagagaaatcgctttcacatggcagctttggtcctccgggagggcagcggctgaggagggggcatgacggggcagccagcgagaccattgttcacgccttggctgctggagccaagcccctaccccagtgccccttatccattggaggaggccgcaggaaaacaaggtctggtacccgaggggcccagtgacccgtttaagcagctcccctcaagcagaagtttcccacatgaccttccagccgggccctgggctttcctgcctccacagcaaccgcagtcccctcgcttggcactgtgtcttggcccagggcacaggggaagggaggaaatggggaggtggggagaggatgcacaggcctagcccgggctcccagctggcaacagcccttcttgtaaggacttctgggccctctgggtcctctgaccacctctttccaccacccaaaactggtcatggcctgcatgggtttggggacccagtgagctacactcacatcactggatgcttcaaagcagctgtgtgactccaggcaagtgtcaggaccgtgggttcctcatgccctcctggctatcaagcttgaagggcccacgtggagattcgagggaaaatgcacactcaggcccaggagcagtgcctcacaccagtgagtggagttcccttttaacatattcttgggtattgcctccacctagggtctgtttgtccccaaatttaagcttcctgggttctgactatgttgggcccagtggtgtggtctctgcccagctggatgtcagcctcccctcggcctcaagggcccagtgctaccacccatgtttccttaccatgactctgagcagtgctggtccctctctgagtcccaggaatggtgcacttgtctgctaccggtatctccactccccaagaaccttcctcacccatcctactgggccacccaggacttctggccctctctggacttctgacaggctctgctataagcccaggctctccacctcctcacacccagcccctcacagggccaacgcaccttagtaggtgcttggccaagggtggcagggccatgttcaatacacagatttcctctatgagactttgcggggaggacagagagcttgccagcagcctggcctcttgtcccgtgccctaggccctttggagggagcccctgccctgaccctggggcctccctacctcttgcactattgcctggccttctatagccagcccctcacacctcccaagctgtggtcacgtggaggccctgccactcacgggccatacctgccatgtcctcggagccttaagatgcaggtgttgagagctcggtgttgcctgtaaaggtccccctggaggggtccctcccatcaggcctggaggctcgggtctgtatacatgcatctgcatggggcatgactggtttccagaacctcagagcccaatccacctgcccacatagcccataccagctgaccaatgacagtgaggcgaatcaccagtctcctcctcactctgaggcctccctgcgctgaccctgtcctcaacttttgatttctccttcttacagcccagctcccacattggactcagttctgtgatttgggatctggccttgacctccaacttgccccagattgtgccttggacttggcccagtccatgctcaggtgggccacccagagccactttgggcctctcagagcttatttcctttggtgtttggtgctgtggacagagaatagtctggcggagaggggagctgagacatgcaggatgctggtgcctggaatggctggcactgagcccatcgctgcctggaaccactggctgcctcctctctgtggcttgtctttgccatagtctgtgagcttggggcccacaccccgtggagcaccatggccagacccaggcagcaaaggtgaggttggcccacagggaaacctgtggaaggctctggcccccaccccatcccaggctcaccctgcctcacagaaagcacaggagacccctggcactggggctggagcccaggacacctctcccaacttcctctggattatgaaatatatttcatgtgatatctcaattcttttcaaacaacatggagtgacatctgcagggcactttcctaatgctaaacaccttgggtcagcagtagaaatgcctccagtcattggggtggctcctaatcttcagatgtcaggcgccagggaacccaacttagggactaagatcctcacttgggaagggtcctgggggccatcagagggatggccatcactcacaggtgagcgagtgtgcacatctggattcatttccacgactcaggatcacatcaggcagcatcaggggccccaggagggatggaggtcacaggctcccaccctcgtcttagccctggaaacatgaaggcctccagtgccctcctccagtaaccccgtgagtgcctggcacaacagtgggcactcagtgaatgccggtaagtgcctgttgaccagagctcatatgggggagtgcacctctctggcaagctggatcccatcagtgtcggcccacatgtgcaccagcctcgtttcagctgggagaatcgcatcaggacaatgggaaagcttctccccgttcccctgccaggtgggcccaacgccagagccgcgatccagggcatcgctgctaagtttccaggctcccgtcaggcatcactcccacccagggggaccctgcactgtctcacttctttagagacagatcaaattggagagagttggctcacatcaaagacaaggcctatgttgtttacacacatttttttgggaagagggaacaaattattttccttcttgtccatgggatgccaatgatgagttctggagaaccactcagagacacctgtcatgaattcccagggcagggttagtggagatggagcaaacagcccacagcgcaggctcctgatttagaagggaaagtgcagcatggattctctaaagtccagcagcagcagcttgcaggagacactgcggcactcatggtgccctgaaagttgcacgggatggaggccacaggggacgatgcatgctgatgacatggcaggaagggcaggtcttgactcagcccaagggagcttctacccggggccgccgtcctgcacttctgagcatattcatcagggacaaggggagaggcaggctcatggccctagggtctgggtccccctgacacacccacacagtggtggagccttgaggacagcctggggcctgctgcaggtgtcccagggaagagggcatgggggatctgtgcctgcccacattggaatgcctcccccatgggaagcactgcaggctgggcaactctgggggaaatcaccaggagcctgcacagaggccccgcccaatgcactggagcatgaagcaaggagcgtctgcctgccctaagggcaccccatctggagagagtgactatggcactggccatcctgtcagccgggagcctcagggaacaaaggcagagagagcccccagaggagatggcagctcaggtgagcctcaagtgatcacctgcaaggaggggatttccacagaggggcgtgagtcgacggtgggatgcagcttcttttattcatttatttatttatttgtttggccaaaaagaagaaagaaaaagtcccactcatctttaccatccagatcacattgggcagaggttcaaggaacctgcgtgtggcaccctgggtggaagaacgctctggtcccgacagcagtctccctctgctgaggccttccctgactccccaacacccgctccccatttcccttcccttctctccctgctctgcagcctgatcatcacagacgtagtgtgggctccacccatttttggagaccgtcagcccttccatggcagcaccttgctttcaccgggctcccagtcttgagctctgccctgagtgcctcccatgcacagtgctcattcattttggttcattcagcaccttcccattttacaggtagagaaacataggcccagagaggctaagtgacttgtccaaagcaaccagctggcgcatggcagagcaaggactccatccaggcttcctgaatctgcatagttaacccctgggccatagaatctaaaatggtaacattatctaaggtctgggatttttgcagttgcaatgttcccagagccgaaaacagtgggtggcacataatgagatcttcataaatgtttgtgaaatgaatgtagacccagccctcctgacactgaatctgcaaccccccaacacacatgcattacagtgagagaaatttgtcatcttggatgcactgaaccacatggcatttcagctcagggtccccactgtctgtgtcggaagcctctggggcctgggaaagcagcacaccccataccctcgagtaagggtaaactaccaggaagcaatgtcgggtgcagagagcatggcctttggagcatctgctggagtcattttcctgaccctttgtccttctgcccacagttctctccccttctcagcacagcatggaggtcagaggccgccgtagaagcctcattgaagagaagacagtctgtactagaaactcaaggattagaactgaggttgaatcccactttcgcacttggaagctgtgtgatcttgagcaggtgttccaacctctctgagctccagatacctctggattgacaaggtcagggtttctccctgagaagtaattttctaacaccttgacatacacactctcctggcctgtgtcctggaccactgggccagtttcaacccctctgctggagacagcagcaaggtccctggacgatccctatgttcgaagtctgcttgccactgcctccaacagcctgtctgccattccccaggcctcagtgctattctgtggtgagcacagaagtgtccttgcccagtctcagtttttatttattttttattgtcagcctcagttcctaaaatcttaccacgttattagaggaaggtatatttttgacaactttatccacagttaccttaaatcaaggtgtcatatacacagtgccaagactgaagatgtttttcaacataaaaatccattttgttgatgcaaaggctgttgagaatcccttttgaaatttcatcagccagtactcagaagacttttggatttgactaacacagaggaatctcttcttggtaaaggacctcagatccagatgttgttccaatggaaaaaaaaaaaaaaggaagaagaagaagaaaaagaactttttccaacattcctttataaggaagctggtgctggggatatgatgtccactttactgggacaaaccaaaatatcttgataagtagaaaattttttttagcaaataacctgctgttggaaattttttaaaaaataaacacagtcctataatctatgtcaagttcagtggtaaacatgaataaaaagaacttaaagaacttaaagagtcaagcgtcatctgggtaccagtaaactcaatgtaagtggtgattcagcaagtgagcttaggtttttaaaatgtactttcaatttttttgttaacaagaaatgagttaacttattaataaaatccaaataaaatgtaaaatgtagtaaggttggcacaaaataattcccatgcatgtgaagtctgcacctgtttatctggggggactataatcttgcagaaacttgaaacatcctgacatctttagtatcttgctctgcaaattgggaattacagcacctacctctcagagttgtttgttcacttcccctgccccacattccaggtgaacccccgacagtgggtgcttgcttccccaagccagaatttaggtccaggtgtgtgggtccttacggcacatcctaagtgacagcatgcaggttctgcctctgaagacagcccttccctccttccctttctccctccctttactccacacctccgcatgagcatctagtgggcacaggccaggggcaatgctctaggacttggtgatacaacagtgagcaaaatctctgtcctcacagcgcttaccatgtagaacaagaagaaagatgctcaaggaacacacagatgtctaaagtttaatgcaaataacataaaagccaagataactgagtcccaggctgttccacccttcccccttttaaaacaatcccctctgctttgcatgcaggcttctctccttctaccctagcccaggtgagggcattcagagagctccagggggcatcaaatggaaggggtggctcaaggtctcaccagcttgcagcctcagcggagagcagtcactgcccctgtccagagtccgagcaagctaagcaggcttgggtctgatcagcatccaccaacaacgagggcatgagggagggcgagtgtgcagagggacaggccacacttcttccaatcccatgcgtggaggcaggcaggtgccctgctgtggctgtggggcaggactcaggggatggaccagctccaggaatgggtatggaacagattcacatggcccaggtcagattcatgtcacagcctggtgggcagcttgaccatgccagcaccagagcacaggccctgccatggaggctggaacctgtgggctgggctgccaggctttgggcttgcggagcaacacacctgccactcaggatggggttttgtctacggcgctgccttgtggacagtgagattggatgggggagcagcagagcagtcaggaatgatgaggacacggggtggtcctcaagcctggtccatctgctacggcaagcctagtttgggacttaaggtggctgcaccattgtagtggttattacgtgggttttcagaaccagtcttcggatcaaatcccactcctgctccttctcagctgggtgaccttcagcaaggcttcctcatctgtaacttggcaacagtgacaggtgccttgcaaagctgtcttaagaattgatgagatggtgaaatccaaacctcaagctaaagcaagtggggagaaaatggtcactgctgtgaacagacatatcagcagcagctgtggtgcatggcagagccgtcccccctgcagcatcattccacgaggcgtggctgggtaggccttgcggggccagcacattctcaccctgcccacctaccaaggcctgtttgtgttaatgtcacagctctgaagcattatcatcagaggccatgagatttcaaaggagcttcctttgcagagccacattgctctgtccataattagcacaagtttccatgagcatgacgatgaggccagaggggctgccctgcaggctggtttgttagtgtaagacattcctggggcatctgcgtagcctgggctatgcttttccagccctcgctccccctggcccctgccctcagcagcccccaggccctcattaagggattagcgatatgggccatgcaatcccttggccatctgcttgagaagtgctgggttctttgctctgtcccgcctgaaccttatcagtggtcctcgcgcaatgtttgtgttgcaaaaatcaaagcaggtcttgggcggaaattatagaccactggtgtcatgagctaattaaagactacggggtcatacacaagggagaggacacagatttctcccactgtctgtccttctgctaatgggacattgacaagcacagaccaggaagaaggctgagaaagccagcagcccgtgagagtatgataaaaggtgacagtgacaggtcttgcttcaccaagtacagattgggggatgctcctatcagggcccagcacccgtcacaaagggtgtggctgtggggcctggcggcaggctaggggcactcccccagcagccatccagagcctgagggaggggatctgtggggggacagtctcatattaatggcaacacatttatgacccaggaggaagtttaggacagttctgaatgtctacatctccatcatcaaaacagattaaaattcaagaataatcttgaacaatggaaaatagacaggcagggaaaaaccaaaatgtaaccttgaatagcttctgctgttgttctctgtttaccaggaggctgtgagcttcttgaagggtttggctcccccacatgcgaggtcggggactggggtgatctaagtgagtgatgggagctcaaacccttgcacatgggatgagataacatccctaggtaccatttgaatgctctctccccctccacactcaccccagttcccagccccaggcagatggaccagactccaccgctgaatctaaagtaaaggcggcaaatgtacgaccactagggtcaatatctggtgacttaggtcctgatgagagtgcttgccatgattcctgcacagagggtgatcctgtactagaggactggctccaaagcttccaccggccagggaaggggtcacaggagcacatcaccacccaagcaagtgtgatccctgccaggactagcagtgctgcagtagccttgcccactctcctgcggtcaggacccctcagtgatggcacacgtcatccagtttggaaagatcatccagcctcaagactgggcagcacctcccactcaatgcacccatgtggccagcccactctaggggtccgggacacgcttctgtctgggtgcgggggtattcgaggggggactgccatgtctgtcagggagtgtgggaagcagatgctgtaaggtgcaaaccagtaattttctggggacaccttctgagcccctcccccttccttcagccattctccatgcccccttttgctgagcataatcctcaatttctttattactcaatccagccttctctggcagaggagtatctactattttccaggggaggcttctcaaaccaaggcctgcaggcgaaatccagcctgctatctatttttatcaatgaagttttattggaatgcagccaggttgatctgtttatgcactgcctatggctgctttcaggctatgatggcagagttgagtggttgcatcagagaccctacggcctgaaagcctaaaatatttactctctgactctttatagagaaaatttactgtctcctattctaggaggtatagaaaaactattttagtttagcctcataatgtccctgggcaatagacgttgattttcatttgaaggaaagccaccaaggcttggcaaagttaaatagaacccagctgttagggaagggaggtgggcctcaaagccacatgtactaactctaaagactgtctttttggcatttgtcttgttgcatctttggcagaataagccgagggtgaaatgttgccttgatcctgttgctggagcagggctagagcttttacacctcccaaacctgcaggatgtctagtaacagcccccaacttttctccatggaagtcccggttaaaatccaaagacaaatgaccctctccatattatcctccaagatccaaaattactcattcaaacagctctttcctcttctccttaggtttgtgacataaaagtgtatccaccagtgagcctcttcctcctccctttgatccaggcattgtgtgtgcatttggagcctgagccaggtgggtaaggtgaccctggatgccgcacgaggtcctttttgggactggcaggtgcctcttcactgggcagtggagacgcaggatgagggagttgatttgtggctatagagaagctgtcagagacagaacctctggttactcagtgatggccctccgggagtcaggaacccaacagacctcatctttagtctgtaggatcccccagaaagcagacgcgctgggcattagagtgcctcttgttctctctattggctgtcaagcctctgaacgcccttagtgcttgaagaactggccccagcatggatgagtcctgcaggattcaggacctagctgctgctacagacacggagcagggcagtccagactcagccatctttctgctgctgcacccacctacttgttacctgaactctgccacccagcagtaagctctgccaggcctcacagtggggtggtggggtgtggcccacacctcgccaccacccacccccacctccaggttgacctcggtggtcaagcttgccttgataccttcctgttctccaagcctgtgctccaggattctctgtcaaccaccccatctgttcaataaattcattttctactaaagtcagcccacacctgtgcagaaacagggttggagcaatttaggtgccttgtccaaagtgataacagatgggaaaaggcagagctgggattcaagcgcatctcctctgaccctaacaagcacaggctgctctcgctagccacacccctctcaaggagcagcactgctctttctagaccctcagaaatgggccacctcccagatgccaggtgtgagtgtcctgacacctgcccctcactctcctccccagccagggcttctctgatgaattttcccaagtcagcctcttgaactacctgccttcctgggaaacaccttcaaatctgcagaggaccaagtgggctccagaaatgaaagtggagcatttcactgtgtgtggagcagtgagaaagggagagggtaggcttggagagtgcagttagcctgcattgggcatcctgacccgtcgggccccaagatgggagggcacaggagcctccagtcacaggaggtccttggggggacaatgcccaaggcctagttgaggaagggggcagagagccggctcccagcacacctgccaggccccacacctgggaccttggggtcccagagatttcttttcaatgcctaaagctttgctctccgagcctaaggacaagtgggcaggacagggcaggatggcatagacttgacctccttccccttgtcccaagttgcactctccagacatgggctggctgcacacatgggctggacactcagggggaaggtcagacttcccaatctgggaccctgattttgctgttcatggccaggtgtctgtcccttggctgtcagctgtgttcaccaggtgtgtgtcccctcagaaggtaagtggctcttccagtgggagtgttgggagaaggaaggagaagagcattctgcaggcatccgccctgctgcaactgcgtgtggctgagtgccccacactctgtgcccagggccacctgtctcccattatggctgaatgtgctaatagggagattccagaccttagttcccctggtagtaaaggtgaccctgcagctccatctcaggggtgtggctccctgaggcagtctttcacccatgagagacttgcccaagatcaagacagcagaacactgaagctgagctgcccctccaacccagctctcgccgaccccaggaatcagggggctccccacttatttcctcctgtgttccagggctaaacattcggctttacacacacacttacctgcatttaacacctccagtcatcagccctgcttgaatcaagttgcctatgtgccagggaagtggtggaggtgaccgctcctgaccacagtcacctggccccactgggcaggagcatctcctggccgggagcagtgagggtgggaaagtcattttctcaagcattggatgggggctggaggggagcagacatgctctgtggtgggctttgggaacacagattccttgttctgggtgagcggtcatgaggcaatccccatttcctcatctataaaatggaaaaagaacctgagaatgctggcctcatgacctcattgtgcggcacacacagggaggatcagtcctgtggtgggtgctgccccaccagggcaggtgctccggcagtgacggggctcgtccacagctgtggcaaccccgatgcccccaccttatctggtagtcattgtcatctgcatcctccctgtcattaacctccccatgccccatgccctcccttttacatcctggccaggctgtctgtgccagctcaccagcagcccatgaaaagcctggacaatgattggagagaacagtaatgaatacaaatcattctctgggcaccacagagcctatcttgggtgatgcagcctctgggtgctaaccatccttggtccttcctggaatggctgtcaggccactgaggccgcaggcttgatgaagatggatgatggcctgtgcctgggtaatgctgtactaacacagagcccagcgtttaatcagagctctgctctctgccagagccgagtaattggaggcaggtgctaagcacaattgaaataaaatgtggagttaataaggacagttgacaaggatgttacaagtcccctgtccaagttttcaacaggaattggaaggcaacttggagacctcagaaactgtgagttaatttccaacgtttctcttcaaaaacaagtacaatcaactttagggctttttttaaagcttatttattttcatatttgcaattcaaaaataagatggtcagaaaagcagcacatgtctaagatacttctgatgtactacaggggacaccagctccatggaggcctggacacccctcttcccaccttcatgctccgcactcagcaccagagtcctccaatctgcctctctggctgtcccttcctctcccagcccattcttaatggcctctgcatccctcatcttgtatcatccaggccattgctaccagcgcagtcttgctagaatgcacaactccctgcagaaagttctattccctcccaagtagagctaagccccaagtctccatggcctggcccgagctgggcccagccttatctcccactgctcctgttcccttttgctgctctagtcatggtgaaaatcctccacctgcctggagggtccctgccacctccactcttaatacactctctccctggcctgaaggatcttccgcccttcttcattgacattcccagatagtgccccaagagctgtcctgagccccgcgcctacttcctgtgcccacccatcccacggacagcactgtccatcacatcacaccctccacaggctgctgccagtgtcctgtctcccaacccgctagactctgcggtgcccaggtcagactgtgacacctgcaggactgcaccccgcatggcgcctgcaccccacgaggcatcagggatgcactggaccagcccaaggctgtccttgtatcatgtgctatcacttactagccagcacgttccctcaaagctgcatgggtgacattgacatggtctgtgcccaccctcttcatcctcaaaacagtcccagtttatgatttcatttcataaatgactgcccccccccaccaactaagaactggaaccgtaagaggcagatgaatgaaaggaaaacagatttaagcctgaaatcctccccacccagccagcaagctgtctcgagtgccctctcggctcagtcttcagtgaagtgacacctggtgaggatgggctgtggattgtccccctcaccagctaatacacctggattacacagtcacctggagaatgagcctcagggtgacccacctccatgtcaaggggaatcttgaggtccatgagacccagctcctatgtgaggggacccacctccgtgtcaaggggactcttgaggtccatgagacccagctcctatgtgaggggaccattccgcattatccccaaagttggagtgcatggagctaccatatgatccagcaaccctactgctgggtctatactcaaaagaaggaaaatcagtttatcaaagtgatatctgcacccccatgtttattgctgcagtattcacaacagccaacatgtggtcactgagcttgactgatgctcagtgtccatcaataactgaatggataaagaaatgagtgaacaatggaatattattcatccgtaaaaaagaatggaattctgtcattcatggccacatggatgagcctggaggacatcatgataagtgcaataagccaagcacagaaggacaaatatcgcatgtcctcactcatatgtggaagcttaaaaagtgggtctcatgaagatagagagtgggttggtggtcaccagggaccaggaaggttagggagagcaaaggataaagaggggttgattgatgggtacaaatatacagttagataaaagaaacaagacctcatgttcagtagatcaatagggtgacaatagttaaaaaaaaatctattgtacacttcaaagtaactagaagagaataattagaatgtttctagcataaagaaaagacaaatgtttaaggtgatgagaatcccaattaccttgatttaatctacacattatatgaatatttcaaattatcacacatacccctaaaatatgttcaactattatgtctcaataaaaaaaagttggagtccaacttcccccaagacaccccaggaaggggttttgtgatgagcaacagctcagagatcagaaagccccctctaagtcttgctgacatcctcctgtctctgtcggggagctacagagccactctggaagcaaatgctcccttccccacccctcaaatggagcagtcccttctggacatggttccaggcccatctttttcctgctcagccacagcacctcttcagaggacctcggtggggtctgcgcagcaccgaggaggcttcactccattcgggcagttctgcctctatggaagacagtggctcagagagtcagagaatgccctctggaatcttctgtggctctgactcacacccagccaaggccttccctctccccacccaagtctgaccatgtgaggagctttgcacacaatgtccctgattctcttgcatccttgtcctcaagccagagtggactcagcgaagtgcaatgatctgagggctgtgcttactcgaggcccacctgggcctgctgtctgctcctccctgctgctcccaggggagtccccccacttccccaacatccccagccccgtctcccctggctccaggctccattgcaatctgaaagctctacaggcagctcaaactcaggtcccaaatggaactcattatggatccctccaaactcactcctcctccatcccctgctccaaagaatgacatcaccaccagccggtccccacgccagaaacctgggaatcatttgaggtgtctctggccctcatctccacccctagcaatcagtcagcattgcggctgcactggcctgaggtttcctgagcccagcccactcccttgcccactgtcattccctggctcaggctctcatcttttgccaaggctgttaccgcaccagcgccctcactgtctttctgattctaagctggctccctgccagtccttccctagcacaggtctcaagatgatctttataaaggtccaacatggtgtgtcattccagctctaaatccctcaagggctccccctacatttcaagaactcaaatgtcttgacacagcaagggagaaccacgtgacctggctcaggcctgctccccgacctgggagcctttctcttctgcacattcaacactgcttttttctcactttgacccttgtatttggactcccttgtcctccatcctcatccctgggcagtggctctcaaacctaagtgtgcatcgaaatcactgtaggggcttgttcaggcacatacaacactgggatcccctcagggtttctgataggtgagtttggggtggagcctgagaatctgcatttccaatgtcaagttcatatgatggtgatgctgctaacctgatggccacactttgagagacagcaccaccactaaaaccttcaataagcgctcgaaaggacccaaaaatgctagccgaatgaatgaatgaatgaatgaatgagtgggatacactctggccagccaaagttttgcagccactcgttaggactctgttgactggatctcacgtatgtgagtaatcttgggtggaatttctgaataagttaaaaaagacaaagctacatgttgcttttatcagggttgggggacccctgtgagtttctcttcgaggtcaggtcctgctgtgcgccctaagggtcagcatctttcccagacacggaggtgggaattggagggcctgggcctgggacctctgaatgcattcccgttacatcatttggatttctttatagactggagagtttacaacatcatcaaaacacatgtttttgtgattttccaacagccttgattcctgctaccatgtcctgttcccaggccaccactgagcacagcagacagatgccagcaagcatctgagctctcaaatgcacacagcatgtcccttctcgtgggcggggagctttggaaaatggaacactgggtgtgaaagacccagaaagggccctgtgaggctgcagagaaggggtgagggtgaggccagcctgcccagccagaccgtaactgtggagactccgtgagtttccagagtcgtgattagcatgaagaagcccctggggcccagcacagccatgatgaccagcacagtccgctgcatcagccaccgagggcctgggccctgtggaactcgccggggtagtgctcatgatcctgcttctcagtgtatctggactaggaaaccccatggtggtcaggacatccaggggagctgacggtctgtggccacatcactctccccttcaggcccaccaggctgaaagggcaaattccaaccctccttcagaaagggagttctccccgagtccttgagatccactgctctcttggggctaaactgtgttaacgaaaaattcagatgttgaagtctcaacccccagtacctctgaatgtgactgtatttgaagatagagtctttaaagacatgactgagttaaaatgaaatcattaggatgggccctaatccagtatgactggtgtctgtgtaagaagaggagacaaggacacagacactcagagggaggaccatgtgaggacatggcagaaggcggcgtctgcaaggcagggagagaggcctcaggagaacccagccctgccgacaccctgatcttggacttctagccctgtgggaactatatgggaaaccgtgggaaaacgactttctgtagttaagccccctagtctgtgattctttgtttctgaagctcaagccgactaagacagactctccagagccctggccaatgcgggcctctctgctgggtgaggaactaagcttagcgtgcctcatgaaggggttcaggggtgtccctgaggcctgtgcccattgcctgctctgtcttccccctggagagggcccttcagctctgtctgccctgggcatctcaatcccaccctggcttcccatccccacagggtgaactgcttgaaatgcagatgtgctcactgagaaagaggggcttgagccaggtttccaggcaatcctcacttgactgagccccagacggcagcactttgggccccatcccccaggcacggcctattcccctggggctgcacagaggctgtggggctgttacctggagctgaccttcggtgccatacagcccttttctctctggcctgagcattagccctctccccaaggcggtcctgcctcctacccccagaggggtgtgcttccctttaatttcctgcttcttccgtgaggatctggaagccaccttgcctctgggtgggacctgaactacacacctatagctggagatgctgccatggagcggagaaggaaggaggtgagctaagagaaggggtgggtgacaattctcttgacaccaactggggacccacaattcaattcatttctaacacaactgcctggagctagcacagaccccacaagctagggactctgccctgcaagactgcacccacttcaagatgccagccacaaatctcaggggccccaggccacctgcacttctgcctggcagagtacacatttgggggctcccacagaccgcccccttgataatttgctagaacaactcacaaaactcagaaaagagctgtccctactattacagtttatgataaaggctacagatagatggccacatgaagaggtccttggggccagatctggggcagggcccatgccctccgggctccccttccagcacacccatgtgtttcagcatcagaaagctccctgagccgcccgttccaggggctttgttggggtttcattacacagacataatggatgcaatcgctggccatgtgacggaacgcaatcttcagcccctgtgcctccctggaggtcagaggtgggcagggccgaaagcatccgtcctgtaatcaagtgcttgggctctctgatgcccttccctgccttatcccactcaggtgtggagaactctggtgagggccctcctctgggatacagaccactggcttctctcagcattttcatgtggcagaaagtgggtaagaaatattctgggggtcccttttataaggcactaaacccattccagcgggctccaccttcatgacctaaatcacctcccaaaggccccaatcctaatcccattaccctagggattaagatttcggcatacgaatttggggggacataaacattccatccattttctctcccctctctcctgagtgaccccatagggttactgggtgagggtaccactctcggtctgcaggccccactcctcctcccactgccgaaggtgtctagacccaaaggaggagaccctgccccgagtcatgctgctcccatactgccaccaggctgctgggatgctgggtggggggctgcagaggcaggtgggggccccgagagtggtgttagggcaccctgcccgatcttctaagtgacaggagagtggggcaggggtggcgcccatgaagaaaggctgttttgctgtccacgtggagagtcatacaggggatcacagtgtacagccttgggaaagctctcactaaatagtccttgaatggaactgggggggcctgaagcaggtgggttaaggggagcctccatgtgtctgagacctaagagcaggactaacttggtgaccagccggctgggtaggcagagcaagggcttcaggcttctgtctgggctgtgagagaccttgtggatgcagggtaggggggcaggaaagagtgtggagtggcagcttcattgcagacgtgctgaagatgaggacacgggagcctgggcaggggtagccatcagacatgaggacacctatgtctgaaactcagaagtcagggcaagaggcacagatttggggctagccatgccatggctgctggggagggcatgctggggctgtgatggagaagtctcctgtacagccctgtccctgacctcccacccctggctctctccctctccccagggcacagcttcccaggaaagaaaagccaatcccatgaaacattggtggtgcaagcctggcagcatctgtaacgctctcactgtgctgttccttgttgggactaagacagccgcaccagcaggcttctccaaggactgggcgaggctgccctgtgaagcacatggcccacaggtccgtgcacccctctgccacgccctggctggggtgggcactggttatcccttccccattggcctcaggatccgggttgcctggcttgtggagacttgtgccatgctcttctgattagccaactgtggaggcttccagaagtgcagggcgacaagcctgtcccactgggccccatcaaaccccccaagtgcttcccttcccactccaatacctctgcatctgaagctccatctgaggctgggaggctcctggcttcttcctagggctctggcatgcctcaccttggcagaacaccctcaaaatgtgaacacaagtgtgttggggtactgacgcagtcgatggggagaacctggcaggtgtggcatcaggctggcagcttctgaccagccccatgacccctgggtggccaccattcccttctctgcaaagaaagaggccatgagtgaccccctcctctggtggggtgaagcttcgaggagatgggacccttgtctgcctggcgcccagcttccactggcaccagtgggcattcagtgcaggaatcccctctgccctccccctccccacccctcctatccaagttgacatcctcactccggtccctgtggggtactcagaaggaaggcccaaggctgggcagagggctcactggatagcccaggagcccaactccccactttctccacccaccaacaccttgtgggcgagcgccccccagagcccaagggcccagggcagcagcccgtcctggaaactgctgtgaggcctggttgtgcactcaggggcagtggccgggctcctggcttccggcagagtcccgctgggaactccaagaagggaatggtgagtgggaggccctgaccttcttcatgtgtgtggatggaggcagctggaccccatgaggagctcaggtcacaggggctgggccctgggagtgaggggtcagggaggccagagccagtatgtgctggttgcaggtccaatcctgtcaaatcctcaccttcttcacgggaggggaggcggtcactctcatgaaccctattttacagaagatgaaacaggctcgaggagggttagtaccctaggctcacacagctgggggcagagctgggattaaaccaggttggatggggccagggaccctgagtgaatgcaccacccacgctgccctgcagaaccatgtggagatgggcacagtgaccggaggtggccttgggggtcgatgacatttgcaggcaatagtgtagctctggctctctgtagtatttcctgcagggaggcagagggcagatggggtctctgcctcatgatcctgcagggaatctgccgtcagcgctggagcacctgtgggcacttgatcctatccagctgtagcagttgtcatccccaggaggggccagagtggcagacagacctccgtgcccctcttcaggaagctaagggtgactggagctcacaggcctccacccagcctggactcctctctcccaggcttctgggagtcatcccagaggaggtggggcccagagtccatcctgtccaaagaccacagacttggattcctgcaagggccaggaaggatgagtaaagagctgaggatggggcctggtggaggctctggccacccaacaagcaccagcctctaagaaaggcacagccactgactgtgcatctgtgggctaccaggctacagcctcatgtggacagggtcggatgagcccctgttcacacaggtctgggctagcaaagtcctacagccaccctgccgcaccacacaggggagggagcaaaggcccccgactgcagaagccccaccccatctggcttcagtcttctctctgtctctggtcctgaggccctcacacgttccctgctctgttcccaacacaccctcctccaccagactgcctctgagagcagggcacaggcagcaggctatgcaagtgagaggctgtggagttaggcctggctcgctccacctccctgctgtgtgaccctgggcaggtgcttaacctctctgagcttcagtgttgtcacttgacaggtggttgtgaagatccaaagcaataatgtgtgtcaagtgctttgcatgcagcagatgaagccttcctttcctccctgaaattaacaagtgcagtgctgggaagtgggagtcaggcataatattaagtccatgctcaaataggttgtgggtctgatggcagaggtttccagctggggctcatctgttagccatgaacttctgacccagaacagaggaggagacacaggttcagcagctgagcgtgtgagttggggagtcaggggatcctgcttcccagtacctgcctctggcagggtcctgattgccgcgcaggtgggcaacgccacctagtgggcatgcatagtgccatgactcagggtattgattgtcctcacacacgcgcacatacacatgcacagagctgtgaacacacacctcaggcccctacccacaccttcacccgcacacaaacgtcttctagcttcttaccccttggatcctatcttggagctgagcatcagcagccataaaaccatgcatccttcctctttccaaaagccaatttggggattgtgtgaggacagccaggtagtctgaaatggaaagggggtgaggtcacatttgctaagggcatgatagtgcatgccaggctccaagccatgagggaggtgtcaccgtagcactgaaaggttaagagcttgcccaagcccacccagagaacacaagactgcaagccccaggctgtgcagctgtacggcctggttcctacaagctccacaaactattccttcataaaaaagggtttttctggatcctttaacttccttcttgaactagattttatttgaaatggaatcaacttgactcataattctatttagggtcccgagatgattttctaagtgacagcagaacctgcattctcagcagccattgtctaacctatgctgtcctcctcctccttctcctcccagcaacggtgtgtgtgtgtgactgtgtggtttgtgtgtgcacaaatgtgtgtgtgtggttgtgtgtgtatatgtggtgtgtgtggtgatgtatggtgtgattgtgtgtggtgatgtatggtgtgatgtgtgtgtgtggtgtgtagtgtgtgtggtgtgtgtgatgtgtgtggtatagtgtgtggtatagtgtgtgtggtgtgtgtgtgtggagtgtggagtacttgtggaatgaatgtgtggtgtgtgtttgtggtatatgtgcggtgtgtgtggtgtggtgtgcatgtgtggtgtgtgtaatatgtggtgtttgtggtgtggagtgtgtgtggtgtgtggagtgtgtggagtgtgaagtgtgcatggtgtgtatggcatgatgtgtatgtgtgcatggtgtgtatggcatggtgtgtacatgtacatggtatgtgtgatgtgtggtgagatgtgtgtgttatatgtggtgtgccgtgcatgtgtgagtgtgtgtaatgtgtgatgtgtgtggtgtgatgtgtgtatgcggactgtgggtagtgtgtggtgtgcatgtgtgtggtgtgtgtgatgtatgtgtgtgttgtggtgtgcatgtgtgtggtgggtgtggtgggtgtaatgtgtggtgtgtgtggcaagtatgtggtgtgtgtgtggtgtggtgtatgtgatgtgtgtgtaatgtgtggtatgtgtggtgtgtggtatgcatgtgtgtggcgtgcatgtggtgtgtgtgtggtgggtgtggagtgtgtggtgtatgtgtgtggtgtgctgtgcatgcctggtgtgtgtaatgtgtggtgtgtgatgtgtgtggtgcatgtcatgtgttgtttggagtatgtggtgtgttggtggagtgtgtggtgtggggtgtgtggagtgtatggtgtgtatgtgtgtggtgtgctgtacatggtggtgtgtgtaatgtgtggtgtgtggtgtgtaatgtgtggtgtgtgtggtatgagtgtgtttgtggtgagtggggttcgcggcaccaacaggcgctcagagtgtggttaaacccctgctctgcaccagatgtcctgggtgtgttcctgtggaacccgtgcctggactgcaggctgctcctggtgccttgtttctaatgaacagaacaaggcagaagtcatcggccaccacttccaagattagattacaaaaaaaaaacctcgggttctgccctgggtgcctcctgcctgctcccttgcctgtttcagggaaagccggtggccaggctgtggcctggagaggaccacgcagcagagaactgagcctggcctcagccaacagtcagcaagtgatctgccagcaactgcctgagtgtgcttggaagcagagcctccgagtgaagagagcgtgtgggacgccctgaggcagaagacccagcgaagccaccccaatccctgccccataggaaccgtgcgaggataactgttgttggaagccaccaaagggagggcagtttgtcacaccgccacagagaactaactcaatggaccttttctgtccccttctgagccccacactccctgctataaagtagggattgggtcacaggtcatgcttgcttaacacggtgcttgggaccaaagagagactcaacaaaagttccctttttcctgtccacactcagaggcaggcttggatcctgctcacccagcctcatgtgatgaaaaactccaagtcaggctccgtcccacagctggggtctgacaaacagcacccccttgccagccacggcagctggagaaggaggtcgccagcagcagggctggagagcagatctgatggcatcagctcgggcttgctccgtccatgccgggctggagtgtggccatcactcccagccacagaagctcgttgatctctgacctccctggtgggaacaggcccttctccaggacaggccagggcacctgcactcagacagtctgcgggtgctccctaggccagggctgacagccccgatggaaagctgatgccctgcctttggcacagtgagtccaggaagaggcacctagccaccacccacatctatgggagacacacctagccagctcctgattccctagcctcactccaggcacctcctaacactccttccatcttcctaaggggcaagaggcagcctcccaccccaacaacgctggctgctgcccaggctagcccagtgagctccatctgcagtcccatggcgtggatcccaggaccctgactcctgggagtgggccctgggaggagtttcagagctgctgtctcccaggggaggctggccaagcccctcttctcctgctctccctcccgtcaggcacagcagccccctgctctgggaaagtacaaagacctcacctctgagacccctccaccttcgaagctctaaaaccaggattctcgcatgagccaccctaacagcaaccctgataagatgttcttcctactttctagatgacgaaagtcagactctaaggctcaagagtttttggcaaggtcacacagcaagggtggcagtcttaaacgtggccccagaatcccttgactttccttccactgaggggtggggtttatgccctgtctttgagcctaggctctgtggctgcttggccaaagaaacactgtggacatgatgctgggccagtttctgggctcaggctgtaagaaacctgggttctcttggaacccaatcatccttctccgagggtgcccaagtggcccaaggagaagaacctggcttggccccctgctggcagccatgcggtgtgccatcttgaaagcggaccctccaccccaccttgagttgcccaggtgatgccacggggaaccatccccatgaagcccgacccacactacaatgtcatgagctaaataaatgtgtttttctaaaccgctaggtttcagggtaattttaagtaactgatacagcaagaagtgatgaacacagttcagatgatctccaagtccacagtctttttgattcccaaccatggctgcctccctgattctcactgtattagtctgaagagcttattaggggaggaacagaggccttgaaaagacccccaaactgaaatccccttccccccagggacagccccctccaggaaattcctttcagggctgtcctcgctgcatttcatctctagccctgcggcaggggtagaattcttagatgacccctaatgacttttgtcttttttataattttcctcgagtgagtaaatgtgagtatgaaaatctatcactctcaagattatgttacttatttcgtgcaaagactttgcaaatgttatgaaggttactagtcagtcagttggccttaaggagatattttctgcttgggtctaacctaatcacaggagacctttaagagtagaacattttttttctggtggtgggagatgaggtagtcagagagatttgatgcttaaaggggcttgtacactagggaggttctcctctcctgagacggaggggccatggggccaggtcctgagaggagcctctaggagctggggtggtccttagatatcagccagcaagaaagtgaggacctcagtccaacaaccacaaggacatgaattctgcccacaatctgaatgagcttggaaacaatttttcccccaaattgtccagaaaagaatgcagtcctaccaacaactcaatttcacttgtgggattctgggtggacaacccagttgagcccaccgggacctctgacttacagaaccatgagataaatgagttaagttgctaactttgtaatttgttacataggaataacaaaattaatatgatcccgttctttttgtttccagactcttccttctccaaaagtgtccttcctttttttcattgcagaccttgtaaatggggtgacatgtagatctttaagccgtggctggagcgtgggtctacagccttggccaaggcccctgggccagaccttgggagtagtgtttccacccatagctgagggctgagtgtgggcccacagtggaatgcctgagcgtgcactagctgggcctccatggcctggcagagccttcctgggctggaccggctgagtttctgagtccaggggatgccgccaatgatcaggctcccagacttcctgttagggtgactaagcccagccttaattaggtggactctgatgatctgttctctctcaatttcctcatttctaggacaataatggttctctgttcataccagaatttcctcctaaagaaccagccccagactcttcacaccatttattcagtcttctccctgtgtaaccccagcctttcccatctctttccttttctgaaacccagccacactcttacagcgcacgcttacactgctgtacaggtggggctgagtgtgcctgacgccccttcacctcctctcctcaccccagttcttggccacactctagaacgcagataacacaggagttcccatgtccatctttgaaatgagaagcctgaggcccagagccctcagcacggaatggaaggctttgaatgcaaacctagagggttcctagttactttatgtctctgcagttactttccaggtttttaaggacagtgatctttgtcttctatcaccactgaagttatccccttcagaaagaagcactggcctagatatgcaacagattgttaaaaaaaaaaactgtctgataattgcaaggttgtgtatttacttatcatatcaagaagaaacgtgtggttttgactctccatttccttactaatcatcttatctgtgctacagccccaccacattatctgtgtccactccacggtggtatgttcaccacatcactggaaaataatgccactcactgacagcacacccccaccaagctccatcttctcagaggatgagggcccagactctcaacaccctcttctctctgccccctgccattgtctccagaatgggagacgacgccaacctccatgctctgactctgctgaaaccctgctcccaggccctctctggtggcctctgactccactcttctcagccacacacagaaacatactcatcttgggtttcttcatccctcaagaatcaaaccagctcccaggccaagccctctgacattgccgtcattggccacaatctgcctccccttccacctctccccaggcctggttcacctgctttttatttccataaagaacaccccattcttttatcctgcaagtccctcctgaaaccattttcagctctatcctcacacacagaccaaacccctgcagagtccccctttctatggctgccttgtcaggaaccaaccatggataaggcaccacctgccttcctctatctcctagccagtgcgacatggaggggaagctgtgcaactgtgtgccttggctccttgacaagccaggcaacctccatgagccccccaggctgatgcacagcccagctcttcatcccttgctagcatccaacagctgttcccaatctccttctttttccccagtccacaaacccacccccacgtcccaaactcgtaccagatgaattcactttataatttattgagaatttcatcctataatgacattctcaccttctctccccttctcctgagaatgtctcttatcttaccccagtgtgtctttttctgagaaatacccttcctctttttgaaacaaacatttccctctggactctaaatctctcagcttcctgattccttcctgacctccttccatttttctgtcttctaacttcttaaatttttattttttagctgtattgagatagaattgatatacagaaaattgcacacatttcatgtatacctcttcatgagtttggacatatgcacacaccatcaccacaactaaggaactaaacatattcatcacctccaaaaatttgtgtacttttttgtaagtcactttttttgtaagaacacttaacatgaactctgtcctcttaatgtattttaaaatgcacaatgctgtattgttaaccataggtactatgctgtacagcagatctccagaacttactcatcttgcataacagaaactttataccttgaaaaacaattccccatttcttccccaccgccagcccctagcagctgccattctactgtttctatgagtttgactatcttagatgccttatgtaagtgacatcatgcagtatttgtccttctgtgactggcttattttacttagtatgtcttctaggcttatcctttcttttgcaaatggcagggttttcttctttttaaaggctgaacaatattccattgtgtatatgcatggcagtttcttcatgcatccattgatggacacaggttgatttcatatcttggctattgtgaatagtgctgcaataaatgtgggagtgcagatatctctttgatataccaatttcttttcttttgggtagatacccaactgtggcatgtctgggtcatacagtactatttttagttttttgaggaactgccatgatgttttccataatgactgtagtaacttacattcccaccaacagtgtaagaatgttcccctttcttcacatctatgcaagcatgctattttttgtcttcttgataacagctattttaactgtggctagatgatattgcattattttgatttgcatttctctgatgattagtgacgtttagcatttttttcatatatctgttggccatttgtatgtcttcttttgagaaatgtctattcagatatttttctcattggattattattattattatcattattattattagccattgagtggtttgagttccttacctattctggttattaatctcttatcagatggatattttgcaaatattttctctcattctgtaggttggttgtctctttgctttgttaattgtttcctttgctgtgtataatttttttagcttgatgtgatcccatttgtccatttttgcttaggtttcctccacttttaaggtattacctaggaacaatctttgcccataccaatgtcctgaagcattttgaactgggacacttttgaaagtgaaggaggtgtcattaataattacgcaggtcaacaggcatcaagtggactgtcctgatcatcctagccccaggcttgccataaggatatttgggatttgtttgaatcgggtgtggtaagacatgcagggattaaaatgactgtcatgaaggaagaggcctccgcacaggtccctagaaacaggaggcgtggtgccccagtcagagcccaacagggaagcactgggtttagtccggggtcaaggagagtgggaatctatgggcaagagcctttattgaggtttctgtgaaaagcaacaggcaaggcaaggtaaacaggcctaagatgagctaatttgaataataggagagggtctggggcacaggggctgcccaggtgtctggcacctggccctgggtgattagggcaggtgagtagtgatcatgagtgagagccccctggagggggtcactcagggtgtaagctctggactggttggtctgtgtcagaaaagcatgcgcttgggtgacttattcactgtccttaggaattggcaacgctgggaggggcagcaaggccccaaactgtcagagcagcagaatacagaaaataaaagggatggctaatatagggactatcagagtcacccaacaggctttttcataaagtccatgctctcttcccacccccgagagttaagtccatgctcccttcccaccccctcccccaggtaagaatgactgcctgagtgagccagtgctacccatgtacacgtgcacacaccaggtgcgtgtggaaagggagagattgggagccagggctttgcctgctgcctccccctgcacccccgacttatactgacttgacacatctaatgcctcaaatctaagtttgtgtccttcgcctgctggactggatcccaccgcctgcctggtgccacagtgactcctattttctcgttcacctggaatgccttccccctccacatgtcgaagacccagctgtctcaaggccctgctacaaggctgtttcctggaaattcagcttagggctctctccctgcctgagtcccagccgcagtttacactccctcccagcgccccagcctgccttccgccatgtccacctctcctatcagtgtgcgcttcctaagcagctcctctggggcagagagaggtgtagacactcttagaatgaacaatgctgcccacctccagcgtaaggcatggtgccgatgtgccagtgccttactccctggcagcatagtaaatgggagcagaagcctctgggaaacacgctgtcttagcctagtgtttcccatagtaggttacagggcatgtgctcttcctggggtttgctgaactgcaaaacttctcacagcttagatactgaggagcctgtgatgaagagattctccttagggcattgaaaacctttttttttcttttcttttttttttttttgtaatttatgtacttgccctcttttttctgagactcatgggactggtggtcttgaaaagcataaatgtctaagaaaggtgctttcaggagactgtagggccccgcttaagcaagtggctcctcccgcagactgcaggtcatgttggctggactatcacctattttactgatgatcctaaacctctgattaaggtgacctttgcctggtgaagctaatatgtcccatctgctccttctctttggtcccccaagggacataaactaagccagcccatccccttgtccttggctccagtcaagctaatcagctttcagtcccctgaattcaccacgcttcttctcacctctgtgcctttctcacactgcctgcttcaaccgcaaatctctctctctcatatacatcacctaatatatatatgaccatatatacagacataaatataataaacacatatgtacatatgtatgaagttggacatgcatgtgtatatgctaggctagaaagatggtagatacataatagatgatatagatgatagatggtggatagatagtagatagatcaatagatagataatagagagataataggtagattatagatgatagatatagatgatagattagatagatgatagatagatagatagatagatagatagatagatagatagatagatagatgataggagagattgcttattaggctgccccttttacttaggacatatctagaaatattcactaaatgaagaaaggtaaattaaactagaaagtaagtgaatggatggatggatgggtggaaggatgcatggatggaagtagaatttgtattacacatattggagaattttaatctgataataaacagaaggtgtggcttgacaaggactccttccttgccagactttagtcagtctgctttgagccctcttcttgactaggccgtggcctgttgaactcagtttacggagacttccccaacccttgatgtctaattaagttcctcttagtgattttccacccactgacacctgactatacccctgcaccttggctataaatccttagctgtctttgctgtatgcagagttgaactcagttctatacttgtctctctcccctactgcaaaaacctttcttgccatttttaacaactgtccagtgcaatttcttcttgacaggctgtgaatgtgtacatgtatagacccattctgggtttcacttggctgctttggacaaatcttaggcattgtaggttgtcaccagcacatttgtaacatgggtgtactgcctactgggctctctgaggaaacccttccagaaagggtcagaaggcaattcttaaatgtaatgggtgctttagaagtcagcctagatttgaagtggtgtatcagcactgaagaaacactgtgttctccttcagcacgctggaagaacagcaacgtgttactcattcaagtttgtcctcttggcccttgggctcccagaataaaagatggcttctctagagtcagaagggcaagagaactgtggggaaggaagtgaacgctggctcaactgctagtgcctgcctggttcatgctaagcactctgtccgtgtggcctcacgcaatcttgccagcaacctgcttgggcagatatcatcactgtttcacacctgggtgctcatccatgtggcttctcttcacctggcctcttggcattagtctagccctagcttctttatagcatgatggtggcttccccagggtagcagaagctgctggtcttcttaagggccagaatcaggactggcttaaaaatcatcactttgtctacattttattggtcagggagtgtcaaagctttgcccccaattcaaggggcaggaaaagactccacttcttgaaagtagagcagtgttcctgaatagggaggggaggaattgatggagaccatctactgcctgccctgacccgggacggggacctggtagggattctgctcactgaggccaggaagcaggtattggacacctgtggcatcatggaccggaagtgcattatacctacctgggccaggtacaggtgctgacggactcagaaacagatgtagggattagtggaatccaggactaacctacactcgcttacagtaagcctgcatgtcacaaatccgaggtggccctgtagagggagccacggcctttttctgctagtttgggctagccctgggccacagcagccagcccatcggtccagggggagtctagaatgtgcagcgaggccctccgggtgcttgctggccaagctgcctgggctgtgtggctgtatcacagtcctgaccgcaccctcccagccttcccagaacagagcttccaaggcgaaaacacctcctggctgttctccttccccaaatggctatgttttatgatgtgctaagtttgggggggaaaaaagaaaattcctccagctgtggtgtaatcccatctgaaggcattccagggatttgatttataatctctgggcatgagccgcatgctgggctctgtgagaggggcgcctgtccggggcgctgcagggccagggccgttgaggccctccgggtggagctgcctcctttgtgggttcccagtttccagcatgctggagctgtctccaagcccaagttgtgcatggaacaggcatgcagctaatattcagaatcaggatgagctcactctgctaccaacttgcataatatttatttattcactcatttaacaaagtttctggggactagaaaataccttaggtactgataatacaaaatgaatatggcaaagattgaaatacgtttgaaccaaggttaatatcagaggtaggtattgaaagtttcaacccaacaatcagcttgtaaaacagcggtctgttttctttccctttttttttttttttttcaagaggggttgaattatttttgtgagggtgctggtaagaggaagctctacatgaattattggagaataacagttctgaaaggagatgtggctgttctaagcccagcctggtgctggtctccccagtgtctttctctcgagaaagaaacaaatgaaagttgatctcagcaaccaggacccatctgggtacccacacctttccttcccagcagccctgcagggttgaggcttgttctcacagcctggaacacaagaatagcatgtgttccagatggagcagaatgattctggcctaggaaagacattataccgaatgggtttcagattcttattggtatctgggaaaggacggacagccacttctacttaaagaaatgcccacaatcccacttcccatcatgggcagaacatgcacatgaactgcaccccacagaggaccctgtgtacagggtggtgcaaggccaacataaaatcaagtcaggccaaagaggaaaagtgtctttgcccaaccgcggtattgtgaagggagccttgcacagctgagtcactattttgattcaaagactgtctatttctttttgtcctccctttgtccctttgtttccttggttgaaattgtgctcggtgagtgaactgtccctggcctgctactagggtcagcagggcctgagtctcatgtcacctttgatcatcattggcagcttctccagctccctgagacagtcagggcagggggctttaaaatctttgagcaactgtatacatagagggctgaatcctagacacagctgacatatactatgacttatttcatttttaaccagtaagtcttgggtctatctgttattagcagaagcttctaagcaaaacaagaattccaaaattcaggaggattagcttgacagatttcccaaacaccttggacagcaacatgagttaaaatgtgacccccatcatcactatgcattcatcatgactagcttgcctctctcaaaaaatggcctgggagagaatgggccagaggtgctgttctatctgtcaaatgtgatctatgtaatcatcctagttggcactgcagaatgaaaactcaaatgtgtctcttctcattccatgaaaaaggaaagctcctgagggttctctgtgacaatacttatgctacttattcttggtcctgtggtggcactcagtttctctaaaagcgaaaggacattatggtggcctacttcacccaaatgctaggagatcacacagtgaaagtcaggtatttgcattcattcactccttagaaactatgtactgctggaaactgaggagcagagacatcccctgcccctacaggacagtgttggtgaggatggatttaaagacaacagagcagaatccgagttgccccctgccctgattcaacaccagctgtcaacatcagctggcagagaggaggaaaagtggcttccaaagacgaaaagaacaatcaaggaagccattcgaagatagtagaaaagaaagcaacagtcagctcaagaatacgcagtagatgaaaactacagcttccacacaggaagagctaaaggagagaggccctcaaaaaaaggttacaagaagagtttaaaagtgagttgaccattttaatgatattgattcttccaatcatgagcatggaatgttcttccatttgtttgcatcatctgtgatttctttcagcgtgtaattaattctccatgtagagatctttcacctccttggttagatgtattgctagatatttttgtggctgttgtcaataggattgtattcttgatttgactctcagattgaacattattggtgtatagaaatgctactgatttttgtaccttgattttgtctgttgaaactttacagaagttgtttaccatttctagaagccttctagtggggtctttaggggttttttggtttagaattatattatctcttatttctttttcttgcatgattgctctggctaggacttccaggactatgttgaagagaagttaatgggtatgggcatgaacagacacttcccaaaacaagacatacatgcaaccaaaaaacatatgagaaaatgctccacatcactaatcactagagaaatgcagccacaatgagataccatctcacaccaatcagaatggctattattaaaaagtcaaaaaataacatgctgatgaggctgtggagaaaagggcatgctcatacattattggcgggagtgtaattagttcagccactgtggaaagcagtttggatatttctcaaagaacttaatacagagctaccatttaacccagcaatcccattactgggtatatatccaaagaaaaataaattattctaccaaaaagacacatgcacttgtatgtgcatctcagcacaatttacaatagtgaagacatggaatcaacctgggttcccatcagtggtggactggataaagaaaatgtggtacatatacaccagggaatactacacagccatataaagagaacgaaatcatgtcctttgcagcaacatggatgcagctggatgccattatcttaaatgaattaatgcaggaacaaaataaaacaaatactgtatgctctcacttacaagtgggagctaaatattgggtactcatggacataaagatggaaacaataaacactgggaactcctacagtggggagagagggagggaggcaagagttcaaaaattacctattgagtactatgctgattacctgggtggtgggatcagtcatatgccaaacctcagcatcacgtaatatacccatgtaacaaacctgcacatgtatcccctgaatctaaaataaaagttgaaattttttaaaaaagagagaaatgacttagcatgtcaatgaaagactttatattaatgacaaactctagtggaatatatgtccattttcttcacttttacgtaataaaatttaaaactttcaaaaataaaagataaatgagtcgacaacggtgcttggggaaaacaattcttgtttgttaatactctccaacccagctcttttgccttccagctggctagtcattaaacagttaaatgaaacaataaagtgtgctcactccctctgtgtatgagaattatgtttccaacacaatagattcctccataacaacactgaatgttaagagaaagtaagtgaaacaatgtctacaagccctccaagtgagaaaaaaatgacacatgaattttatacagagccaaaatgtcacatacatataaagaacttcaattaattgaaagaatgccagaaatcaaggacagtagaacttgtgagcccatcttggaaaaccttttggaggatgaactgtcatcagccaagttatgcataatgaaatttctatatactagctaaagagacaaaacaaatttgtcattacattatgctctttggatatttaattcactcctccttatcctaatattcctaatttcataaccagaagctgaagtgatgtcactttatccatgtaagttcttctccaggctcttcaggtgctaatatgcttaaatctcttcaaatattttatagtgtttgtttttgtcgacaattggaatatgaccatgttcctgcctgtcctacttattatacgggtgtgtcaaaagggcaagtgtgtcacagggcaagtggcatagcaccaggagatacacacctgcacgaatgtccatgtatctgggtgtgggcaaccagagtgcacatgagaatgagaagggctacttctgtgactttcctgaaccaatagtcccaatagagccaggctagagcaaaaccacagcctccaaacccagaggtgcctcccccagcactgatttaggagcccccagcccatctccaagtgttgtgcggcactctgaagttcctcctcacccccttgaggcagctgctccgtgggtctctggactcctcaaactctgattcccctggcagaacaccctcctggctgcaggtgtggctcctgtcccagcctcaaagcaacaggttcctgtgctcccatcattacagcgaagagctgagggctcttttcttttaattgaatcccctgaggaacgccccccaacaacaggatatccccaggctatctgttcttatcatactcataatgtttggctttgtcatgccattcacccagcctcaacttaacacactttccctgaaggtctaaatccagacaaaaatatgagcaacccttctcaacacttggcctccctaacataattacaaaccccttattcatagtctttggctctgtccagagcttaggcagtctcttcatgcctggatgattctcccacacagtatgtgacctgagaagtcaggaatgatcattgtgctctaatgtcatagcaagtggcatgccacctagctctgggggtggcagtcggtgccagaggccctgtcattgtcttccctagaggccataagaactctcatggaaataagttgaccccacaggtatgccagcccagacatcctggtgaggccccagcatgccccagttctcaacggcaagcagctcgggaagtaccgaaaggacccaggcaccatttagttttgtaaggccattcagtaaagctcaggctcttggaaagccagcctctttgattcagtcctttgttgctactcgctttaatgtttacctcattttctgcttcatgcagccagaattactggtaaataagcccttcagcaaccgtagagtcttgtgctctgctggagatgtatatgcttggagaatgaaatactgtgaacatacatatttcagtttggactgtgaaatgccttctatacatctgatttgtaagagagatggttctgatcgctaacatctcagtggtgatcctgaggagaaaggcttgacagaattttaaaggtgctctatggagtataattaaccaaatccaccccccctccgtatctgaaaaagaattctggcagtgttaccagtgaggaagataggttcttttgcataaagggacgtttagttgtttccctggggttattatttccaagcctggctgtgtgatggactcagtttccccagttgcattccaatccattcttcagaccagtccaaaacagtacttaacttataggagagaaacagtgttttaccataaaatgtgcttctgttgtaagtttgctgtagctatgccctagcagattaaggtaattcccttctattccaagtttactaaaattttttatttttaaaatatagaatggatatcaaatttgattcgaattttttttctgcatctattgaggaatggctcttgggaacaatattttctgagctcttgcatgttgatttcaattttcaccctgtgcatcaaggtcagtttttctagacataacatattggctcataaaaatctttccttggacatcttattattccatcttcttttgtattaaagcattactcttaaaaatctgataatcatctaattttcttttcctcatattcttttgcgtaaatcctcccccctccccattttctttcttcaaactgcagcaattttacttaaaatttattaaaccttggtattggtcatactcatttgatggtttcaggtatgtactatgatacttcaacatataattttaaaaacaattatttcaggaaaattttctttaattattactctaaatatttcttgaattagtgaatttgttctgaacccttgctttggtttttcttctttaaactttctgttatctatctactagtcttctttacctatcattgatccttcttatgctcttaaatcctgttttctttctccattttgttttgaaattattcctcttaagctttctatttattgtaaagcatcagttatcaatttttttgtgttccttctagtttatagattttatttctaatttttgtttctaactctttcttgattttcatactgctttaaatttttctagttctgatttttgttattccatcctgttttatgcaattctcctattgtctttaagctcattttgaaatagtaggatatcgttttctgtgacttcccgagctgcttgccattgagaactgtgttttgagtgtatctttctggtgtaccttcattgtttgtaagggatgctattcagctcctcagtcttttttttttcttatggtaacttgtacgggatttgatcataatattttctagtgcttgtttccatgtgaatttggatttcctgaactaaacttgacttggacagacagctcttataagttcactgagcttgctttctgaggttttctggctctattctcctcaatcacttttataggatcttctcttttctttatcccattctctccattctctcctcaactttgattctaaggtttctcctcagtgtgactctgttctggaaaggagccctggctggtcaccttttagagcagataagagctacactgctctaaccccttcaggccctaccatgtactcctcgcacttttccactttgaaggtgaaattaaagggatacaaagaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatgctacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgttgggaaaactggctagccatatgtggaaagctgaaactggatcccttccttacaccttatacaaaaattaattcaagatggattaaagacttaaacattagacctaaaaccataaaaaccctagaagaaaacctaggcattaccattcaggacataggcatgggcaaggacttcatgtctaaaacaccaaaagcaatggcaacaaaagacaaaattgacaaataggatctaattaaactaaagagcttctgcagagcaaaagaaactaccatcagagtgaacaggcaacctacaaaatgggagaaaatttttgcaacctactcatctgacaaagggctaatatccagaatctacaatgaactcaaacaaatttacaagaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactattggtgggactgtaaactagttcaaccattgtggaagtcagtgtggcgattcctcagggatctagaactagaaataccatttgactcagccatcccattactgggtatatacccaaagtactataaatcatgctgctataaagacacatgcacatgtatgtttattgcagcactattcacaatagcaaagacttggaaccaacccaaatgtccaacaatgatagactggattaagaaaatgtggcacatatacaccatgggatagtatgcggccataaaaaatgatgagttcatgtcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacataaagtataataataatgaaattaaaaaaaaaaaaaaagaaagtgagcaatgcccatccagtttcagacgccatcctcagcttagccccaccacacctcctagtaaatatctgttggatctttaggctgtgttcaggtctatcagttggtaaataaaacgggtccttcaccagagtttgagaagcattgctgaaggaatcagcagagggagagatgagtgttagaaggcttcatagaagagatagttcttaggccaggccctggagggcaatcagggttgaagtgaatgttgaagttcctcagtgctctgcccttggcctccatctcactttgtttgtggagcttatccattcccatgccctcaaacatcactttcaaggcaagcattcctccagacctgagttttcagctcaggaatcttttttaacatgaaacttgtagagacacttgcataggtataatgaattcagcatgaaccaaacaagtgcatgactttctccccaagttttgtcaatgaatctcaaaagttttgttgcgtttttattttcgttcagttccaaatattttgtaacttctaattttttctctgactcataagttatttagaagtatgctgtttaatttccaaatattttggaattttaaaaatatcttcacattattgatttctagttaattccataatcatactttatatagttacattcttctgaaatatagtgagactaatgacccaaaatacagtctcttttggtgaatgttctatgtccgcttgaaaagaatgtgtattctgctgtagtttagtgttctgtaagtatcagttaggtcaagcaggttggtagggttattcaaatcttttacgtcttattttctgtttacttgttctatcaattacttagagacaaatgctgaaacctcaaactctaattatggatttgcatatttttccagtttgatcttatatatccatttttgtttcatgtatttgaagctctgtatttgaaatgctatccttagcatacagtaaattcacaaatataaatgagtctgtaatgctcaactctattttgttccatttatctatctatatatccatgtgccagaatcagattgttttaattactgtgactttagataatactttgactatcgttaaggcaaaccttttccctttcctccagttaatttttctttctcaaaaatatcttagctcttttcatacatttactgttcatttagaatgtaagcatcatctgggcacgttcttgttaagtttaatcttaagtatttcacatattttataaaatatacattttatatatgcctgttgctcaaagatatttttcctgttgaagatacagaacaggggttggcaaaaattttctttaaagggccaggtggtaaaaattgtaggctttataagacatatgatctctgctgatactattcactcagtcatcgccataatacaaaagcagccacagacaatatgtaaacaaatgggcataaaactttatttacaaaaaaaggcaagaagtcagatatggcctgtgggccatagtttgctggttgtagataaagagacagactaatagatatagagaaagattaatttttacatagttatcttgtatcttaacttcataataagtttgctaatactatttttgagttgagtctattatttctatgtgaacaacgtatgaacaaaagatcattttcttctagctttccaatatttacagcaattattccacttttgtaatcttactgcattggctagataactctggagcaatactcagctactgtgctaacaggaggtattgttttgttaataggggggctctgtttttcacctacaaatttgatgttgctgttggtttctaaaaaatgttatcacgttcaagtttcagatacaatgcttgtattcaatcttttaagatcccttctaattcaaattgtttaattatgaagtaattaccagtttttgattgaggctatagacaaatgagtgttccagtgagcaatccatcacccccattgaataccaatgacttgtttttacttaatagagaccttctgaatcttcttgttcaattacatgaacctcaagacaacatagaagaaaacgaattcttccgaggaattagaaaaaaattaagtaggaaataaaagtattttgctttagactttttaaaggtgttttcctttgaggtttttcaataaaaataaatcactaaaataacttttgagtgctaaaggtaaatttagctgaaaattcaataatgttctaaggagattgggggtaaaaggtccaaaggaagataaattactaactctaatatggaagaaaaaaatctaagatgtttatttctgaaaagctttggtctaacatgtaagcctcaagaacatacaactttaaaaatatgtatttaaaattgaaagttaataaatatatatatgcttatatttaaatattttaaaacttcctttaaattagcattcatatactcacaaaggtgtcaatgaaaatttcatgttcacattgcaggcagaaattgattcattattgatataaaattatttcaatcagtcaaaagttttcactttggcattcaccttccaagaatgaagtgaaaacaaatgcaattagtatttccatattcactcctttaatttccctggaaaactaaaaattagtccagctgtaaaaatatgaggcacacattaaagaagagacatgtttaacatcaagcattgtggaatttttctttacaagacgatttcaaggcccagataaataaaaatacttcaggcaatacacagtaaatattttattttaataatagcatagaattcttctgaagaaaattgttatacattatagctattattttacagtaacagagagaaaataaaattagagatacaaatattaaaggccaattatcaaaatgaaattaacacagattattattcatatgaacaatgtaaacagaatcatctatttgatttaacatcaaatatatttttggcatataattatttttacaatgagaattattaattattcaaccaattcaaatatactcattcagccaaaagaacaaaataagcctcttagaaattcaagatttatagattgatattaaacattttctcaatacatagaatattctgatctccattgagttaaactgtacaaacactcatatctattgttttatagcttataattaggtatagcttgtcaccagaactccttgtccaaaatatcactattaattgtacgaggcaaagtcctataataaaattactgtaataatggccacatcttttcaaaaacagaatatggaagtttccattttcatgactatgaatctggttttccaaaattgggttcccaaatccagtttctaaatgtttcaacagaggtgagaaagtaaaggaaataaatgatttaatggaactctggaaaaaaaactatcatagatcttagtttgaaaaatacatcaaacatgagatataccatgaatgactcagaattatataataatgcctatatcaaactttattagttagctaaagggcaaagagtaagaggcaagttaaaggtaatacttgcttttaacaaagcagactaagtaatatgttaagtgttagggtgggataggaaagaactcaggcatggcaaaaatctcctcttgggctttctatataaacatctattttagttttggactgttcaccgagaggagctctccctatccatgaaatgcttcccagaccaacaggtcttggtctagcagctgtaggaaggcagcagtatgaaaatgtaggaaatggaagccaatttgtgtccaaagttagtccaccctaactggactctttttaaactgggttattcaaatgccagcaaaaagtacaggctctagctaaagaacatgaatagacatctgtcttaaaaatgcctggaagaggtcatgattattggccttatgttctcccagaataagaacttacaaagtcctggaaatcctcagctctctccagccacctttccaaataaaatcttaatgaatatattttaaatcctttattgggctctgtaatcccttcaaccaaatagccaagctgcaatcgttttatgtaacatctgtttcactggaaaatgtgggaagttattttgatattgtctagcaagatcaataagtaaacactgatcaccccaagccaaatgatattgcccttcagggagcttttagaaagaaaataaactgataaaccaagaaagcagattgtatgcatagcaaagcccttcagcacagtgcaaacatgttctttatgaggaggtgcaaacccacttggtaatttcaagtgagaggcaacagaagtctttcttaatccaaagtcagaagtttccgaagaacttcaagcacaatatcgtaacaaaagtgatactgctcctatatacatatatataaaaaacaacagaatgttaagtaattgaataacagaatccactttcagaaaacacatttgtaattttcagccacactggaaagttcctaaaaagagcaaacatttaactataaacacttaagaactttacgtgaatacatttttaaaactatgaggaagataaatgatcaaaatatagctcttggcctagaactagttaccttaaggcttaacataactgttttttttatcattatccatattctattaatctaccctcccaatgactactaacaaatctgtgacataaatgatgtctttttatgacgtcctgataaccttgacagtttagtggcaagtaaatatctcaaactgctatccagaaatgttttaaaaataactttagatgttacttaaatagcacggcattatggacaaggcatgtgtttggacacgaggagacctcaacttcaggcttggctcctccccttctatctgagtgaccccatggagcaggctttattgctctgaatttgaagtacttggtcaggaataccagagaatcagagcaaaactaatgtctacctcaaacagtaggaattcaatgagattatgtcaataaaagagcttttaagtggtaaaatgttatgcaatgttaatctttatattcattattcttattattatgtatgtggtgaaagcttaccttcgtttgaaccatgccagaacgttgttctctcatttgggccactatatccatgatgttgaactgtaataagatgacagtaattttgtatgatccacatgggggaaaaacacaaattcacagattgccaaaaagggtgaaagagatgtcaagatttaatcagaaagatctcattttcactcacaagaaaatgtgctatttttaacttagcccaatggataaggaagactattttaataggttttcaggagaaagcaggaagcaatcattcataataagaaatgctctccaaaataagtaataaatttgcccttgtgtgtccctgtttgttatccaaaggcagaacttaaagcagcactgtaattctggaaaggcacagaagactttctctggccccaacaatagcatatctgtttcttatatgaagatccctgtcaactcacacggaaactgggagcaacagtcgacccaacactagattccagactgtgtgtggacaccagtacagctgggtgtggtcattgagttggtgcaggcctacaaaggtctgttgctggtccacaatgagtcaagaaactgggagtaagtgctcagaaactcttatggcaatttgacactggcacagcactgagaagtgtgctcaactgaacaggatatagaccagctcaggtgttgctgaacttgcctggagagtcacatgtgggacaagctgagaatgagtcgtttcagcaagacattgtggacacatgtaaatgttgtcaactgtaaccccaaagcatataaaaatagaaaacaataagcattcctttattttcatagcttatcatttttataattaaaatttttaattaaccctttgaaaaaactttttgttttttagagacagggtcttgctctgttgtctcagctgctggagtacagcggtgtcatcatatttcactgcaatctcaaactacaatcctccctcctcaacctcctgagtagcaagaactataggtgcgttccaccatgcccagctaacttttttatttttatttttgtagagatggggtctccctatgttacccaggctggtttcaaactcctggcctaaagtgatcctcagccttggcctcctaaggtctgggattataggcgtcagccaccatatctgccataaaaaacattttattttataatacagatatacaggaagttgtacagggtggccctgtgtatctttcacccagtttcccagatggtgtcatcttgtttaacaagatataatatcaaaaccaggaaactgacattgggacaatccacaaagcttaattcagatttcaccagttttacatgcaactgttagtgagtgtgtgagagtgtgtatgtgtgcatgtgtgcatgcacagagctccatgcaattatatcatatgtgaagattcatgtaactataaccacagtccagatacagagctgttccaccacaagacttcctcctgctatccctatagagtcacactcatccaccccaatctctaacccttggaaaatagtaatctgttctccttctctatgcttttgctatttcaagaagaaatagcaaaattcactatatgaataaaattgcacaatagctaaccttttgtgattgacttttttcccacccagaataacttggagatccatccaagttgttggtgtaacaatagtttgcttccttttattgctaaataatattccatgatgtggatatgtgccactttatttaaccatcaatttgttgaaggacatctgggttgttctggtttttggctactgtgaatataatctgctatgaacatttacatacaggtttctgtatgaacataaattttgattaatctgggataaatgccccaagagtgctattgctgggttatatgtcaactttagttagttttgtttttgttttctttccaagaaactgctcaattgttttccgcagtggctggtaccagtctacattcccaatgtctcatacatatgggtaatgtatgagcaatacagtttctccaaatcttcacataattctccaaatcctcaccagcatttccaaatcttcatcagcatggggtgctgtcactatttttacataagcctttctgataggtgtgtaatgctactccatcctggttttaattagcatttccccaagggctaatgaagctgagcatcttttcacgtgcttgtcatctgtatgttctctttggtgaactgtctgttcatgtcttttacccatttctgtttttcttttttttttaactattgatttttgagggttccttataaattctagatccaaggcctttgttggatatgtgccctgcatatagttactctctagcttgtttttttttttttatcctcttcattgggtctttcacaaaacataaaattttagtttgctttccctctgagatcagtgatggcaacaacgcctgctctcaccactcttattcaatatagcacttgacattttagtacagcaataagaccagaaaataagtaggatgtatacagattgtatacagatcaaaaaggaagagacaaatctatatgcacatggcatgactgtctatgtagaacacactaaagaatctaaaaaaaaaaaaacctacaaaacctctaagagctaataagtaatttcaacaagatcacagggtacaagatcaacaaatgaaaatcaattaaatttctacgtactagcaatgaatatgtggaaactgaaagtacaaacacaataccatttacaattgctccaaagaaaatgaatagggtaaatttaacaaaacatatacaagatctatacactgaaaatgacaaaatgctgatgcaagaattcaaagaagacctaaataaatacacttaccatgttcatggattggaagattcaatacagtaaagatatcagctctctccaattaaactacagatttaaagtaatttccatccaaatcccagcaagttttgtgtagatgtagccaaactaattctaaaatttattagagaaagcacagaccctaggatagctcaaacaattttgaaaaaggagaataacgtgggaggaatcattctatctgatgttaaagcttactatatcactacaataatccaaagggtggtaccggcagaaggatagacacactaatcaatagaacagaatacggaaccagaaataggcccatacaaatatgcccaataatttttgacaaaggtacaacaataattcaatagaggaataacagaattttcaataaatgatattgaaacaactagccatcaataggccaaaaaatgaatcttcacctaaatttaataatttattaactcaaaatggactatggacttaaatgtcaaatatgaacttacagaattttcataaaagaacacaaaaaaattattcaggccctcagctaagtgatgagctgttagacttgatatcaaaacatgatccataaaaggaaaaactaataaaatacaatctcatcagaattaaaaactgtaacttctttaaaagcatttttttaattataatttaagattaggcaaattatggaaatacatttgaattactaatttttaatcagtttactgactataaaacaagcatgactggactgttcagttaagaaaagacacagctttccaaatgtggctgtagtggttaaccaaataatgaagatggaagtgactgcaatgaaatgaagacaaagagttatataattttcacttggagttatgattcctcatatattgagttttatagtcattattgattgtgaagctctaaaactacacttgtgttatttccaaagatgtactggttaacaaagcaaaggaaccattaagacttatttgtaatttacataaaaaataattaattcaaagataaaataattatcttaaagagaattagattaaaaagacaagagaggacttctggttccaaaataacagtgtagaagcaagctggcttcacttctttacaaagaaaaccaaaaccaaatatacagcactgaaattatcaccaacaatatcccagaaatcaaatacgaggagaagacagttcctggatccacagagatgggaaaaaaactctaagtaggcagtaagagaattgggtttccacatctgcaatgcccattcctccaatttgcccagcaccaagagtgcaaaaaatctccacctgattcatgatttctataccagaaaaggtgacatccaggtttcccaccatctgggttacctggcaggaaacctgtccctacctcaacccacaggaagcactacatgtgcctgaagaaagaaatatcctgagaacagtcagaaacaaacaggtgaggtgggactaccatccccagccctggaaactctggtctgtaactcagctaaaggagatgccaaaccagagtggttgtttagtagcaccacattgcagaagatacattgcacaggacccctgggcatgaatctctagccacctttcccacactgccatgatatctcctttgagactttccctaattggaatgagcagctctcttattgtttactggagccaaggcaaacttggtcgtaaggtgacatctagtgccaaaaagaaggcagcaacttagcccctcaccaaaaaaaaaaaaaaaaaaaaagaaaaaaaaaattcgacaggtaaattacatagaatctataaccaaatacattcaataaaaaacaaaaataagccagacagagaacactggaataaataactaatccttcattcaaagacatcaatacaagatatatatttcttgcacatccagaagaaactgcagtcaacacaaaaccatgacctccccaaatggataaagcaaggaaccagtgactgaccctcatgagatagccatataagagctccctgatcaaaaattcaaactagtattaatagctttgaggaaactcagagatctccaaggtaacagaacaccaattcaaaaatttattagacaaacttaacaaagagattgaaataatttaaaaatcaaatagaaatcttggagctgagaaatatattagctgaactgaaaaattcattacagcctcacaatagcagaatgaatcaagcagaggaaagaatcagtgagcttgaaaaccggctacttgaaaatgcagtcataggtggaaaaagaataaaaaagaatgaagatcatcaccaaatatagacaattacctcaaaagaccaaatccaaaaattactggtgttcaagagggagttgaacaagagcaaggggtaggaagcttattcaaagaaataataacaaaactttccaaaatgcaacagatataaatattcaggtataagagcatcagggccgggcgcggtggctcacgcttgtaatcccagcactttgggaggccgaggcgggcggatcacgaggtcaggagatcgagaccatcctggctaacacggtgaaaccccgtctctactaaaaaaatacaaaaaaattagccgggcgtgatggcgggcgcctgtagtcccagctacttgggaggctgaggcaggagaatggcgtgaacctgggaggcggcggagcttgcagtgagccgagattgcgccactgcactcccgcctgggccacagagcgagactccgtctcaaaaaaaaaaaaaaaaaaaaaaaaaagagcatcagagaacaccaaacatattcaacccaaataaggctacaccaaagcataaaataataaaactctcaaagctcaaggatagaggatcctaaaaagtagcaggagaaaagaagtaattaacatataaaagagctccaattcatctgacaattgactctcaacagaaatcatataggccaggaggaagtgggataaattttcaaagtgttgaaagaaaaaaaaaacctgttatccaagaacactatattcagcaaaggtacttttaaatatgaaggagtgataaagtatttttcagataaacaaaatctgaggattcaacagcagcagacctgacttacaagaaatgctaaagcgagttcttcagaaggaaaataaaaaaatacaaaaaaccacatacacattcaaaaagaaaacttttcaaggcataaaatccactggtaacattaacaacatggacaaaaccagaatactctattattgtaatgatggtgtgcaatccatgcctaactctggtatgaagctgaaagataaactcataaaaagccgtaatagctacagcaacctattaagagaaaggtaatataaaaatacacaaatttagataataagcagttgaaatgtggtggggatggagttaaagcatagagtatttttttaaaattttttctttgtttctattctttactttgtgatctaagataagttgtcacttctttaaaatagcttattgagatccactcaaggcaaaaagaactgggaagtccccacagctgtctgctgggcagaaaaccctaggctatgggtgccacatcagccatacacccacggcaacaccgccctgcctggagatctcacacccttgacctactgcatcaacaaaccatctgtaggtctactgcacaattagctctgactcccaagcacagaggatcagcaggcctccagtgtgctgtggatctcctggtgacctaatctttggctcgagctgccccaagggaggagagagcacaggctgccagggttccccttggggttaaagagatgtgggcatggtgccagtgactggagggggctcccctaaggcctggaaatggacctggcaggggatcatcgctaccccttcccaccacccccactgctgcaaatgtgctggaatacaaaagagccatgtgactgagagtctatttgccggccattattctcaagcaccatctactggattgaagcctaaattacaacaccccaaactcttccagtatacactgcctgtgaaatccagtgccagaatctagccacaagtattaataaatatcccatacagagtgttggccctctgaaagcacccagaaataaagccaactgactatactcagcttatgctacagtcaaacccacaagggatacaaagaatataaaaacaaaaagcctcatcgaaatgatagcaaattcaacaagataaaagaacacgtgccctctcagaagagaaagatttaatgcaagaactttggcaattcaaaaagtcagtgcctccttatctccaaacaattgtactagctcgccagaaattgttcttaactaaattgagatggctgaaatgacaaacatagaactcagaatctgggtggtaaggaagcttaatgagattcaggagacagctgaaacctaatccaaggaatttggtaaaatgatccaagagttaaaaagttgacaaagccattttaagaaacaaacaaactgaccttctggaattgaaaaattcactacagaaaatttcataatacagttggaagcattaacaacggaatagaccaagatgaggaaagaatctcagagctcaaagattggtccttcaaatcaattcagtcagacaaaaataaagaaaaaagaatttcgggccaggggtggtggctcatgcctatgatcccagcactttgggaggctgaggtgggaggatctcttggggccaggagtttgagacctgcctggccaacatggtgaaaccccatctctactaaaaatacaaaaactagtgaggcttggtggcacgcgcttgtagtcccagttactcaggaggctgaggcatgaaaattgcttgaacctgagaggtggaggatgtagtgagctgagatcacgccactgcactccagcctgggcgacagaccaagactctgtctcaaaaaaaaaaaaaaaaaaattgaaaatgaacaaaacctccaagaaataagagattatgtaaagagaccaaacctatgactcactggcatttctgaaagagaagaagagtaaacaacttggaaaacatatttgaaaatatagtgcgcaaaacttttcccaatctcactagagaagtcaataggcaaatttaagaaattcagcaaagtcctgtgagataccatacaagatgaccatcctcaagacatatagttaacagattcaccaaggtcaatgcaaaagaaaaaatcttaaaggcagctagagagaaaggtcagcttacttacaaaggaaatcccatcaggctaggagtagacctctcagcagaaacttgaaacttacaagtgagaagaaactgtggacctattttcagcattattaaataaaataaactccaaacaataatttgatattcttccaaagaaagcttcataagcaaaggagaaataaaatccttttcagacaatcaaagctaaggaaattcatgagcactagaccagtcttacaagaagtccttaaggaagtgctaaatgtggaaatgaaagaacagtacctggcaccacaaaaacacaagtacatggcccacagacaccataaaggagatacacaatcaaatctacaaagcaaccagccaacaatgtgatgacagcatcaaaatctcacatattgatataaaccttgaaggcaaatggtctaaatacccaacttaaaaggcttaggatggcaaaatggattaaaaaaataaggcccaaccatattctgtcttcaagagacccatctcacatgtaagaacacccacaggctcaaagtaaagggatggagaaagatctatcatgcaaatggaaaacaaaacgaaagcaggggtcactattcttatatcagataaaacagactttaaaccaacaatgatctaaaaggacaaagtagggcattacacagtgacaaagggaaaaattcaaaaagaagagttaactatcttaaatatacacacagctaacattggagcacccggattcataaaacaagttcttctggacctatgaaaagacttagtcacacaataatattgggagccttcaacacccaactggcaggattagagagatcatcaaagcgaaaaattaattaataaagaaattctggtcttaaattcaacacttgaccaattggactcaataaatatctacagactagtccactccaaaaccataggatatacagtcttcttatctgcacatggaatatactctaagatcgactatatgctcagccataaagcaaatctgaaaaagattaaaaacactgaaatcatctcaagcatactctcagaccacagtacaataaaaacagaaattactaccaagaagatctcccaaaactacacaattacttggaaattaaacaacttgctcctaaatgacttttgggtaaacaaatgaattcagaaatcaaaaaaattctttgaaattaatgaaaacagagacaaaacaaatcaaaatctttgggatgcagctaaagcagtgctaagagtatagtttatagtgctaaatgcctacatcaaagaagttaggaagatcttaaatgaacaacctgatgtctcacctagagaaactagaaaaaaagaacgaatcaatcccaaactagcagaagaaaacaaataaccaaaatcagagcagaactgaatgaaattaagatggaaaaatgcatacgaaagatcaacaaacaattttttttttttgagatggagtctcgctctgtctcccaggctggagtgcagtgacacaatctcagctcactgcaacctctgcctcttgggttcaagcaattctcctgtctcagcttcccaagtagctgggactgcaggtgcatgccatcacacctggctaatttttgtatttttagtagagacggggtttcgccatattgatcaggctggtctcgaactcctgacctcaggtgatccacccgcctcggcttcccaaagtgctgggatcacaggcatgagccaccgcgcctggtctgttttttgaaagaataaacaaaattgatagactgctagctaaacaacaaaaaaaggaaaatctaagcccaatcagaaatgacaaagatgacattacaactaatcccacagaaatataaaagatcttcagagattattataaatatctatgcacacgaaaaatagaaaatctagaggaaatgagtaaattcctgaaaactcccaagattcaaccaggaagaaattcctgttcaagaaaacctgaacagaccaataatgaattccaaaagtgaatcagtaataaaaatcctaccaaccaaaaaaagccctggaccagacggattcacagctaaagtctaccacatgtacaaagaagaactgctaccaatcctactgaaaccattccaaaaaattcaaggaggagggactcctctctaactcattctatgaagccattatcaacttgataccaaaatctgacagagacacaatgaaaaaaaagttcaagccaatatccccgatgaacatagaggcaaaaaaaaaaaaaatcctcaacaaaatactagcaaaacaaatgtaacaacacatcaaaaagataatgcactatgaccaagtgggatttatccccagaatgcaagtataatttgacatatgcaaatcaataaatgtgatatatcaacagaatgaatgacaaaaaccatatgagaatcttaatagatgtggaagaagcatttgataaaattcaacatgctttcatgataaaaaaaaaaactctaaacaaatgaggcatagaaggaacatatctaaacacaataaagacgatatatgacaaacacacagctaagatcatactgaatggggaaaagctcaaagcctttcttctaagaactggaaaacaggtcaagaatgcccacttttaccactcttattcagtataatgttggatgtcctagccattgcaattagtcaagagaaagaaataaggggcatccaaattggaaaaaaaggaaattaaattgtccttctttgcatgtaacatgactatatattcatatattcatatatatatgtatatatatatatatcccccaaaactaatgactctaccaaaacactctaagaactaataaactaattcagtacagttgcaggatacaaagtcgacatacaaaaatcagtgatatttctagactccaataacaaactagctgaaaggaaataaagaaggtgatcttatttacaatagctattaaaaaaaaaaaacacctaggataaatttaaccaaaaaagtaaaagacttctatgaggaaaactataaaacactgatgaaagaaacgaagaggacagaaacaaatggaaataatcctatgctaatgaattggaaaatggaatactatgcagccataaaaaaagagtgacatcctgtcattcacagcaatatggacaagtctggagaacattgcattaagcaaaacaaggcaggcacagaaagataaatactgcatgttctcatttatatatgagagctaaaaaatcaaactcatggaagtcaagagtagaactgtgggtattaaagatgataaggaaaggttggctaacaaatacaaaattaagctagataggaggaatgagctctggtgttctgcatcactgtagggcaaatatggttaattataatttattgtatatatttaaagagctaggagagaagatttttgatgttcacaacacaaagaaatgacaaatgtttgaggtgatgcatatgttaactaccttgatctgatcactacacattgtatacatatatctaaatatcactctctgtaccccacaaatatgtacaattattacatgtcaactaaaaataaaaggaaaaacaacatagatggaatcattttaacagataaaacttgagaataaaaataatcataaaggaaatattgtaatcatcacatctgattcctgtgtctatctcttagctggttccaaattaaaaacaaaagtaaaggattgtgaattattgactcaaactcaattatattattatgtttattttgcaaatgagaaaactagatttgagagaggatgagcaatttacccaaagtcaccaaaatctaaagtatgtggcaaaacaggcagtcaaacagggacccctcattaactcagaagtctacattttttctcacattcttatgtgcttgtcacttatattcattaaaaacaggcacattccatcaacattctctagtaagagtctaaacaccccgtgtaagatacagggaaggaaaaggaaatggaactcacattttctgtgtatctattatgttccagacactgtcctaagccattatttacaatacatactttaatcctcacaaacacccccaggaacctgcagcaagttcggtgagaatcaggtatccaaagctcatgtgcttttgatttactaagttgcttttgaagaccaaatattagtcttccaaatgatcaggctattaaatgtagtgtgtaaacaccaacagcatcagtgtatctgcttgattcacacacttactgaacagttctttacgatggcacagaacacgacatccacacataggaacacccctgtccggcctatgccggcactgcagtgaacaaccatgggtcctgtaaggtggctcttccttgcataacgaatatattttatgaagctatctgctgaggcaggagtgccatggtctggccacttggtgaactgcaactgttttacagagtgactagttcccgtctgttagagaaagaaacagagcgagaaagacatttattgatttcttatattagagacctcacgccaacttctaatattcaaatgataataataatggctatatggtattaccttggtattatatagaactttcaaaaagtactcaaacctctttttgatgtttataagaattctggaagttgctaggaatagaggttttctccattttacaaaggagagcacagtaacaacaataaaaataccagtattaacaggcaacaaaaattaagcacttgctatgtggcagttactatgctaggggcttcacatgaattctctcctttaatcttcacatcaaccatgtgagataggcaccattttatctccattttacagatgaaaatttaaggatgagggggacgagagatgtatgctaggtcagaaggttcacacgtttagagctggaactgtaatgtaggtgtcttgaattctaatctaccatcattcttctgtaccatgaggctacaggaaaaccaagatttcaaaatgcttagagtgagagatggactgtcatgttaggaataagaccaaaaggcaaagtatcttagtttagaaatgacatatgaaatttaattaagacatataggtgtctgacaagagaggcaccgatctcttccagcgatgaagacagggtagtcaatgaccatgagagtagattgtgggtcccactattgtgctgagcccccttgaagtggagtcatgaaactcttcccagcattgtcagataaagcactttgaatttacctatatctcatccaaagggatcatgaccctttcctcagtgtggggcccttattttatcacacatgggaacctaatggaagaactcaaaatgagtttctcacttctcctatgcttctcccgaatgcacctctttttcctaagctttctgaataaagatgctagtgctcagagctctattctaatccacagtgtcgactgaaatttgtgatagttaattttatctgtcaacttggctgagccctggtatccagatactaggccaaatattattttgtgcctctgtgaaggtattttttaggtgagattaacatttaaattggtagaatttgagtaaagcaggttattctccataaagtgggttggcttcatctaatcagctgaaggccttaagagaacaaaaactgacctcccatgagcaagaaggaattctaccagcagattgcttttggactcaaactccaattcttccctgggtcttcagcctactttcccaccctgcagatttgccaaccctccacaatcacttgaaccaactccttaaaattaatctctctctctggatcagtcccataacctgtattcagggatctcaatgttatactgctagaaaaatacacataatcacatattttgttgctactacaaatgtatgggtcaaacctcagcatcactcagcaacccttttcctggtgattgtgctccaatcaacttctttggtgatgactccaaaactcaccattctctgcaagtttcctgttcaactcctattcccttcactcttgttaacacatgtatcacctacctgccaactgaatccactagagcaatctaactcattgctttctcctataaaccattccttttctgttttctaagtctattagaccaaggaatccatgaattattctagaccaatgcttctcaacagaacttcctatactgaagcaaatgtcttaaatagtggcaatatagtagccactatcaacatgccactcataagccctaaaatgtggctacttgcaggtgaggaactcaatttgttattttacataaatttaaataacttaaatttaaacttaaatatccacatgtggttactgtattgaatatattttcaacccctcctctgtcacttataaatcataagtcataagtcacatatgtctcccaattttatctgcaaaacacttgcgtctgtgctttccacccccatgccaacagccgtagttgatcatgtcacttactaaaattcttcaatgtctcccaattatcttcataataaagttcatgctacttagctgaaatttaagacatttcacattctagctggcccctgcttacttttgagaacctcatctcatcttttattactccctggcactgaacttttacatttcagaaacacataactacttatatttgtctctacacacaccttatgctattttatattttgatcatctactttctccctccatctttttcatttgcataattctcaaaacaaatgccacctcctccagtaaacctgtctcaaaaccccaagtaaagccaagtgtttaccttctgagccccaaagtgcccaagacatatctcaacattatcactgaacacggtaagttaggtatctatcagtgagtgtaaccaacctctccactattcggtaagtactgatagtgcctggcccagtgattagcatactttaaggactcaatacgtatctgctacatttggcagaggcaggtataacccagaatcagacaacttcaacagtcactctccctgccccacctctcttttccaattttttcttctccacagaatctggttgaggagaagtagaagtggtggtggcttctggtaccagggacaagtaaaaagttacttaagaagtatcatcgatcgattttccatcctactcctaacttctagttctaagacatctgcttatgtggtgaaacatatatctaatactgatgtttaaaaacttacggacttctccacaacttgaaacattcgaatgatgaaatattgaagtatctggtagttctccaggaatacacggaagtgtttcaattccaatggcttcttcagagaaatgggccagtaatggtagcatttgataattccaccttctatctctctggttatcatggcaataacatttgaattattttccaacaccatttgccaaaagtcatctatggtgctcagcagtggtccttgagtagcgatataaaaatactcttctccacaattgactattctaatataactagcattgatgtagtccttgctttttccaagaggaacgcgtgttgaatcatctattacagaaacagaaacatctggtagataaaggtgggagatacatcacacccagacttcacgaaaggatttcacacatgtaaatccatatatctctttgaccaatagagaagatggcctaggagtttcttttcaaaatggttgagtccatgagtttaaattatttcctccctgaaaactattggcatgacctaagaaatatacaattatgggatgtttatttttcaaatcagtttttaataaatgcagaatgatatcattagcatccaggtacttttggaaatttctgctagaagtggcatgggcaaggttaagtcaagggaagtatcctatagtttgcaactgaacacaacagaggagaaactctttgtgggagtaaatgagtgatattatcctgcaaatctgaaacctgcaaacccagagcagcaggagccaggggaaaaaaaaaatctgatagttgactgcagacaaattctaggattaatggaattccaccactgtccccaaactagacagccatattttatgtccattctcagccttcatctggtgataggacatgttattcaaagcaaagatattgtggcaaaaggatgctaccaaggggaattgctccaagtaatatgggactcatctaacatggactgttataacaaatacgagagggaaaaccagctatttggcctactaaccttcactgctccaggagttccttcttcacctgacacagacatctgaagctctggttccaccaccatccccacagtgagagcagaaacacacacagcaaaggaggcccttctctgccatgcagctctctcaccaataacctctccttactactcagaatcacatggaccacttatctagtaaatatgctgacaagacctgaacaggcatttatataatatctggcagaactcttctcaaattttaacatagcacacagaaactttcccttgtaaatatgaatgaacagaaaaaatcagccaggcgcggtggctcacatctataatcccagttactcaggagactgaggcaggagaatcgcttgaaccagggaggcggaggctgcagtgatctgagaccgcgccactgtacttcagcctgggtgacagaatgagtgagactccatctcaaacaaaaaaaaaaaaaaaaaaaagctagatatataaagatacccggtatttcaaaaagggagaccattctaaaaaatcacaacaaatattctcctttctataaaagatgataacaccttaaaaactcctatttgtatattaaataaaattcaagagagcattaattatttaaaacaatactttatacctatgtttactaacaaatatgttatattactaaattataaaggtgataacaatggctttgtagggagatctttcatcatatttatgtagatatatgatgatatatgtcatataataataataagcctggcaagtgttcatcacaatgttagcagtagttattacagtatctaaaccatataaattacttcatagtaaaaaaagcattttttaaattttgaaatgagattaaatatgtgaaaattaaataatctaaaataataaaagcttgatttcatataaaagtcacaatcattcaactcaaactcctaaagcaggaattgaacagaaaaacaaatttatgtttagaaaatcagcttaaaaaattttcccagaactcagaaaaaaaagattaaaaaaacctacaataatgattaaaatggtaaaagacacagcgcatacaaggggaatgtaaaaaacgaatttcagaagcaaactgtggaattcactgcagaaaagaaataattcaagtgatcataggaaagctccctaaacagaagcaggagtactaacagaatgcagtgaaacatgcataccaggttcaagcagcatgatacgctacatgtatcaccttgtcaactccaaaacaaacctttgagggaggtgctattatattcatacttttcaaataaagaatctgtacaaagtaacttgttccatattatgcagcaatcttctagactccacagactaggtaaatctagactctggtccaaaaataattccatgctctgttgtccatcaaggaagactcaagtttgcagacagaaaggcctaagtgtcagacaacattaatgaagagagccactaagacccctagaccagcagagcataaggccacaggaacaggaacaggaagcaaaaattatgctaatggatgactaggggtaatggcaactggtgccactcccatttccaccccttgattcttgaatcttggctatggtagaaacagcatcatatattggatgctgacatggggcatgtataatctcctgaagaacattaccccagccctgcaaggtactgccacctagctttcactgtaattgagtcttcaaaaggccattcatccattctgtcaagccagccgctttgagaggataaggaatatggtaacatagtggcaatgaggccattgccacaaggtatttgccacaaagtgagttctttgattacagcaatgctgtatggaataccatgatggtggataaggcattctgtaggtccacagatggtaaattggtgggagcactgtgtgcagggaaggcaaatccatacccagagttactgtctattctagtaagaaaaaagcactgctccatgcattatggaagtggtcccagtgtaatcaacctgccatcagctagctggctgatcatcccatggaatagtgcccatcaggtactcaatgttggtctctgttgctggcagattggacactcagtagcagctgtagccaggtcagccttggtgagtggaagtccatgttgctgagctcatacataacttccatccctgccattatggccactttgttcatgagacctatgggcaatgacacaatgacaggggtgactgggggtatagtctagctgatattcatagagcatgtcactctattcacctgattattaaagtctgcccctgctgagatcaacctttggtgagcattcacatgggatacaaatatctttgtgtttgtgcctatctagcaagatctattcacgtgcctcttccccagaccttattgtcaccaatttttccaaccatgttccttcaaattccctgaccatccagctaagccattaaacatagcccatgaatcagtacacatttatacgtctggccatttctccaagcaaaaaacaaaaaaacaaaaagcaccaagtgcactacccaatgttctgcccactgggagttatttctcttcaccactgtccttcagagatgtctcaaaaaaggggctgtagtgctatagctgtcctcttctggctggtacctttatatcacgcagaaccttctgtagaccaggtccaagtcttctcttcttctgtcagctgatcataggcaactcctcatgagacaacaggtgctggctgaagagagcaggtaatgtagcaggggtgggaacagtgagcatttgggcagcttcttcgtgtaacttatttgtgccttcaggatctgctcaagcccaatgttgtatctaccactttcatttgatggtggagtgctgctgtgtatgcccaactttatggcttggtggcccatagttaagcattctctacttagttctctatgaagcagtctctaccaaggcccagtagcaggccaaaagctgtttctcaaaaagagagtccagagagggtggcaggaatttgctctaaaatcctacgtgcctgcactgtgattcatctaaaggggtctgccaaaggtccaaacagcatccttatctgccaatgacacttcaagcaccactggatctgctagatcatacagcccacgtggcagagaggcttgcatggcagactgatcctgtttcagagccttctcttgttttgggccccactcaaaactagcagcttttcacatcacttagtaaatggaccagagtagcacatcaaaataaggaatgtttcctccaaaacgccctggttcactagccattgtgcctcttttttgcttgtaggaagagccagatacaatttatccttcaccttatgattatctccacatgtcccacaacactggacctctagaaatttcactgaagtagaaggccactgaatttttgttggatatatctcctaccctctgacagacaaataagactaaagcatttgctacttcttgttcactagatccaatcagcacaatgtcatcaatgtaataaacctctgtaatatcctgtggaagggaaaggtgactgagatccctgagaactaaactacaacatagggctgaagagttaatacacccctgaggtaggacagtgagggtgtgttgttggccctgccagctgaaagtaaactacttttggtgttcttgattaataggtatagagaaaaaagcatttcccagatcaatagctacatagcaggtatgaagagatgtgctgattttctaaggcaatgaaactatatctggtatagcagctgcaactagagtcaccatctgaggaagcttacaataatccactgtcattctccaaattccatctcttttttgtgtaggtcaaataggtgagttgaatgggatgtgatagatatcaacatcacttcatccttaaagtccttgatggaggcattaatatcagcaatctcttcaggaatgtagtattgcttttgcttttttactattttcctaggtagaatcagttctactggcttccactggccctttcctgccataatattcctcactccacaggtcagagaagcaatgtggggattctaccagtttctgagtatgtttattccaattattcattccagggcttggaaaataatcacaagatggttttagggacctactgagtccactgtgaaatgaacttgaactaaagctccattgactatctgacctccataagcccctgctttgatttgtagaccacagtgatgttttgggtctcctggaattggtgtcagttcagagccagtgtccagtagtttctgaaagttctgactattttctttttccaaatgtacagtcaccctggcaaaaggctatagatccctttggagaaggctgaaagattaacagtatacatttttagcagtgtgccagggtcctccctttcattcaaggtgttctctgtgtgtaaactggctcaagtctgggaagttattgactggttgtgattctctgttcctatggttcaggttagaattttgctcacttgacctagaactcttctgcttacacctatcaaggaagaatttagtagacgtcccatctagttcacttctaggaacaccatgatcaactaatcaacaccacaggtctctacaggtcagactgttctgattgctgctttgactctgctattaccataccatgctcaccttgcctttggctatcaagtgccaccacctggcccttatctctctgggatccaattatacccactgcattcaggtttcccaactcagtggcagcaatttccactgcaatatctgaactacagagaagaacaatcacagtattcttcaaggattctgggactcgcctcacaaatatatttctcacagttatgagaaaagtacatcctctggacctcctggggtgggttggcaggtcttaaatgataaacctaatctaatattccaatctccctaatcctttggatcacagtatatagtatatcgaggcagttctggcattttatcttcatttagactgggccaccttttggtccatttaatacaaccaaccaaataaactgtaagagctctttctaactccctaatccacatattaagtccagaatctcttctttgtggtcccatttcaataaattcagcctgatcaaacactaagttccttccaccattgtcccacacccttaaaatccctccccacaaatatttcccagatttctgtcagtataaattggaaaaatcatgtagctcttttgtagcgtaacatacctccccatgggtcacactttgtaccttacctttaagggcctgctgggacttgagtctagttataggtctagaagcaatgaaggatggtagctgtgagtcttgagaagaatcagcaatgtcttgcaaggcaacaaactcaggggaggtaataaaagtttcctcaggtaaagtagcatcaatctcctcagatgggggtggcatggctgcttttactggcaaggaagactcatcagggtcaaggggttcgatacacccagctttataaggctcttcacatatgtctgcactccagttttcaagatcccattccttctcagttaatgccctcattttaacagcagacaccctaaaagggtggggattcaatttgcactgtaattcagccattttcaggatgagattttgggtttggttttcaataatctcagctttgttgttataaaatataagagtttctttcagggcagaaagagaaacttttgggttattcatgcggcacttgagctgggaaatttaatccctaagatcatcctttccttctctacattaggagtaactagccaatctcattgttctcatgagaactcaaaaatgttctaaggtatcaaatacagatgcccagaaccttgcttcttgtaaatgtctgaataggattacctaatggcaatactttgcatatctctactgtcacattacactatgaattattaatactctattcactactgaaaagtcattaatgcctttacatcttatcagattagggaagtaattcataaaactcatccttaaaattctgttcctctagaattgctctcagtaccaaattctgttactctagattctctagataaatagaatcaataggctgtatatatacagtgagaaagatttattttaaagaactgactcatgattgtggggactggcaagtcaatatctgcagggcaggccagcaggttagaccccagggaaaagttgacattgtagtcttgagtgcaaaggcagtctggaggtagaattccttcttcctctggaaattttagcgtttttttcttaatgacttcaactgactgaataaggcccactctcgttatggaggctaatcagctttactcaaagtctgctaatctaaatgttaattacatcttttaaaaaataccttcacaccaacatctagactaatatttgaccaaatagctgagtatcatagcctagcctagttgacacatgaaattaaccattaaacaagctaaaaattttagtagatgatttgaaggaggaaattttttaaaaacttatattagtttcctataaaaccaagtgaaagaaaaaaataagaataaaaatgagagagagagagagatagagaaagtacttgcaaaactacagaggtaaaagaagtaacgagaaaaggttttataagatagaaccaagaggcaaccctaaaattcatagaaactaaaaaaaaaaaaaaaaaagacaagagtagactgaagagtagaaattacaactaaaggaagatcaattaaagggtttatttgtctaggtaagaatgatggaaatgaagcatacctggtaacattatttaattccaggaaaatagttaaagattttgaaataaaagagcatatttctcatgaagaaaaggagtcagatggccattacagttctcatctaaaacactggaaggaagaggacagtgaagtaacactcagggaaaaaaaatgagaaaaaaaagaactaaaacccaagattcctaaaaccaacaaggatattcgtttatcaggataaaaaaaaaaaaaaaaaaaagtagagcttgagactgcatcaactacttatacccatctccaatcaaacaattaattcatcagaacagtgatttcaaattaagggaaaagggaaagaaaatgaagtaatagcaacaaatactacaaaacatagtttcatatctataagaagaatgacgagagccaggcattccagctacttgggaggctgagacagaaggatcacttgaagccaagagtttgagaccagcctaagcaaaagcgtgagtccctgtttctaaaaaaaaaataaatgaataaaaaattagctgggtatggtggcacatgcccatccccatagtcccaactacttgggaagctgaggtgggaggattgcttgagctcaggagtttgaggtttcggtgagctatgattatgctactgcactccaagtagactctgattcttaaagaaacaaaacagctctgtgcggtggctcatgcttataatcccagcactttgggaggccgaggtgggtggatcacctgaggtcaggagttcgagaccagcctgaccaacatggagaaaacccatctctactaaaaatacaaaattagccaggtgtggtggcacatgcctgtaatcccagctactcaggaggctgaggcaggaaaatcgcttgaacccaggaggcaaagggtgcggtgagctgagactatgccactgcactccagcctgggcgacagcgagactccatctcaaaaggagaaaaaaaaaaaggtttcttgaaataggaaagaaaacaatgtacaataaatacagtggtggttaggcctgggtttgaatcccagatctctctcctatttgcagtgtgaaagtgagaaaattacttatctcttttagcctttctgtaaacaaggacactaacatactgacaccttagaggtaggttgttgtggggattaaacattactacctataacagacttaaattagtaataagcaatagtaataaacatattagtgttactactactattattattagtgggtggtagtagcagaaacaaacatagagcaacctcaagaagtacagaaagaagcttgttaaatctctgccttgaagagcttgttttcccatctatctatattataatgctgaagtgtatgaaaattttttaaaagtgtaatataccttttgcactcacaaaccacctttttaacagtttatggaggtaaaactgtcatacatgtgcacccatgagaccaccaccacaataaagataattaaacatctccatcagtgcaaaactatcctcatgcctctttataatctatccttcttgctctcatcttgccccaaggcaaccactgagacgttctgtcaatacaaattagtttaaattttctaacattttatatatgtggaagcatacagtatattagttttctaggtttgaaatttattttcacattctggaggctggaagtccagtattgttatggtttggatgtttgtcctctccaaaccttatgttgaaaactgatccccaacattggaagtggggcctaatgggaggttttgagtcatggagacaaatcactcatgaatagattgatgcccttcctcagggttgagtgagttctcactctattcactgctgcaaaaaccgattattaaaaaggaccaggcacctctctctctccctcttgtgtcctctttcaccatgtaatctctgcacatgctgattccacttcaccttctaccatgagtggaagtagcctgaagccctcactagaggcccaatcttgaaccttccagccagcagaactgggaattaaataaacctcttttatttataaattaaccagccccaagtattcctttatagcaatacaaaatggaataagacagaaaattggtactgagaattggggtgttgctataaagatacctgaaaatgtggaagcagttttggaactgggcgatgagtggaggttggaagtgtgtggaaggctcagaaaaagacaataatatgagagagtgtctggaaaaagtgcccaaaggcacttcagaaatatttggggccaccccttccctaataggccccaaggccttctggggacagacctggagcaccactgcccttggccacctcaggatgctgctccccacatcctggctgctctggctccagcagtgggtcaaatggccccaggtagggtttgggccactgctcctgaggggctaagtggtaagccttggtggcattcatgtggtgttaagtctgcaggcatccagaatgcaagggacatggaggcttggcagctttaacctaaatttcagagaatatattaaaaagcctgggaaagcaggcagatgcctattgcaggagtggagccaccaaagagagcccctaccaaggcaatctttagtggaaatgttgggttggagtttccttagagtccccaccagggcaactcttagtggacccacaaaggtgctggaaccccacaatagtagagctatccacagcattccacctcagcctgaaaaagctgcagcattattacaacccatggaagcagccagtggtctacgcccagcaaagctatgggggaagggctactcaaggccttgggagcccaccccacacaccactgtgaccaatatgtaggagatagagtcaaaggagattattttggagctttaagatttaaagtgtgccctgctgtgttttggacttgcatggggcctattatccctttcttttgaccaatttttcctttttggaatggaaacatttacccagtgcctgtaccaccattgtaccttggaggtaaataatctcttttttgattttacaggcttacaactggaaagaacttactttgagtctcagatgtgactttgaacttttaagttggtgctgaaacaagttgacttttagggactattgggaaggaataattgtattttgcaatgtggtaagaacataagttttaaagggccgggggcaaaatgctatgatttagatgtttggcccttctaaacctcatgttgaaacttgattcccaatgttggaagtggagcctaatgggaggtgtttgagtcacaagggcacatccctcattaatagattaatggcaggagtgagctctcactctattcgttctgcaagagcctggtacctccccatttctctcctgcttcctctctcaccatgtgatctctgcatatgctggttttacttcactttccaccatgagtggaagcagcccatagccctcaccagatgcccactcttgaaccttccggtctgcagaactatgagctaactaaatccctttccttcataaattattcctctatagcaacacaaagaaactaagacaaagatcaaggtggcagcaggcttggtttttcctgaggcctctctccttggcctgccaatggctgccttcttgctgtgtcttcacatggacctttctctgtgcctttgaatccctgatgtctcttgtgtgtcccaatttcttctttatataaggacatctgatggattggattgggcacactctaagaacctcattttatattaattactactttaaaggccctatctccaaatcaggtcacattctgaggtacaaagggttggaacttcaacatacaaattttgggagaatttaatttggctcataacacacagtatatactcttttgactggcttatttcactgagtaaaattattttaagattcattcatgttgttcaatgcattgttagtcattttttattgcctagttgcattctattatgtagacataccacaatttgtttattcactcttccgttgatgggcatttgcactgtttccagtttttggctattataagtaaatctgatatgaacattagtatataagtctttatgcagacatatgctttaatttctcttaggtaaaacatatgaatagaactgctaaatcatatggtaggtacatgtttaactttattagaaacaaattccatttcattgcagtgagtgtaaaatggtatctcattatggttttaatttgcattttcctaatgatttacaatggtgaatatcatttcatgcatttatttgccatccttatatcttccctgagaagtgtctgctcaaattttttgctcatttagtgttgggttatttgtcctcttcttgatttgtagtaattatagattataaatataagtttttgtgagataaatgttttgcctgtatttttcttctagcctgttgctttcctttttggttttataataatatgctttgaagagcagggttttttttttaatttgatgaagtccaatttattttttttcttttacaatttgagggttttgtgtcctatttaggaaaaatttgccaaagccaagggcagtaacgttttctcctagggtttctttcagaagttttatgtttttaactctaatgataggtctataatctattttgagttaatttttatataagttgtgaggtaagaatcaaagttcatttttggtacatgaatatgcaactgtccagatgatttgttgaaagattatcccttccttattgtcttgcattaaatttagatattatcatcttctctgttcttctcacatgatcatacagaacactcaatgagaaatatataagcatgctctgaaaagtgagaagctaacagaaacctaagtcactaccttgattagttctgaataggtccctgatagataagtaacagaaaaaatattaggccaggagttggggaacctctgtgactcgctcttttattagccttcaaactgctttgtaagttgtgaaatggtaaagaaatggaagatattgtctttatacctaaaaattcctatactacataataaaggccattcttgcttggcatgatggtacagggccataaatatgaccatgcaagttgaaaccatgcgaaaggacctttgttgttgttgttgttgttgagacggagtcttgctctgtcgcccggggctggagtgcagtggcgctatctcagctcggctcactgcaagctccgcctcctgagttcacgccattctcctgcctcagcctcctgagtagctgggactacaggggcctccaccacgcccagctaatttttttgtatttttagtagagacagggtttcaccgtgttagccaggatggtcttgatctcctgacctcctgatctgcccgcctcagcctcccaaagtgctgggattacaggcatgagccaccgcgcccagtcacaaaaggatcttagtaattaataggaaatattattcttgtttcatggctcttaacattttttgtgaaatcattaaaaactcacttattgctggctatacatatatagagaagcaaaaaatagcaagactaatatttatttagaacattgtaatttaaaacattagaaatattgggaattaaagcatttaatttgttaaaaaaaaaaacaaaaaaacaaaacttacccagagtagtttgaacagtgtttgcctcttctttttgttgtataacttacaatacagagtgagcattttttctatgtctaggctaacttccaagtctggatcagtttccaccttttatccttggcacttatattgttgtgaaatagctccaaagtttctttaatgtcaagttttctaccatcattgcttcccctaggttgcctttatccttttcctcacaagcactttggtcattcatgtcggtaagttccccttccacaggtgccttaggctgcagctctagggtcttttgagcagtagcagtgtcagcatgtccctggtcagctagttcttctataactccattcaaatttcatttccaacattatcactttttatccctttattgcagtttcatctctctcagccaaatctctctcttgattatacattttggtaaaaggtcataggggtttaccattgagagacaaggagacaatacaatcacatgctttgctgtgtgtgaactgaataagaggctcacagttacctatcactgacatattttgaaagaagtaacatttattagtcactggtcatgatgcacatctgttatttacatagggacttgtggactaaagtgccagcaaagatgcttactactttaggcaattacttgcagtgaatatattgtggtaactaaaatgtgaattgtactgtgggactggtgttatttagctaaacacagtaactgatatttgagcatattggggccatgcaaagtgaaggttccctatatttgcagtgttcaaaggtgtgtgaattcatctatttagtgttctcagcatttgaagacgacaaataaattacttctttagctttcttaatatgagtcttcaggaaccttttctataaagtcaagaaatgtgtgattaaaaaaaccacagagctttctatgatggccacttaagttggctgagtttcagattagattacactgcgttatgaggtagatataccaatgggcctttaaaaagaatatggttgaattatagtttcttttcttttatgaaaagccaaaagttttacataacttcccttactttaatgatttaacattatttttattatctttgaatttcttagttgtaactcttttgatatccagaataaaaacttcaagtcagatcaaatattatgtgtaccttctattgtaaaatgagcttcttacaatcccgagaggctaatttttaaggcatgtttgcttttagtctccttgagggcaaactgcacatgcagaaatagaaattataaaatttggacctttgacattttggagaagcaacaaattattagtattatttattaaaatgtctaatcatggttcattattctgatttcagaagtattcatcaatgcacttctccacactctccccacagaagataacagaatagcttattttaaccatgttggatatgtacttgttttttatcatcataaagttagtttcaattctaataaaccaactaaacatgaaggtatttatctagtgaccgcagtcactgtgttccactctggtttttataataactatctcaagtctagtaggagaaacaaaagtgaaaataattaaaatatggtttggtagaaggggagagtggttacaagatgctgtgagactactggaaaaacaccaaacctagctttgaggaaaataagaaaagcctattggagctggttaagaaagatagcaggaactgcctcagcaaagaagggatgagtagttctttcaagaactgcaggttaagaggcataaaaaccaacaaataagaaaagaattatgaattctagataccaaaagaagttttgtgggagagctaaggctagagaggcaaacaggtgaaattcttaggccatgttaaacaactgtaccatgatagtaacaaagagccaagaaagagctttaaaagaagagctacatgttctgacttgcattttaagaaaatctcagtagcttttgtgaatgatcagaaagggaggcagtaaagaagaacgtaaccagctgagaggtaaaatgggctcagtctaagtcagcagcagtgggaactgagagatgggggaggaccccagaggtattatggaggtagaatcaactgactccctgttttctggtttgaacttggtgattacataagatatagaatataagaagagggtcaagttggaggaagtaaaatagtaaatttagttttgaaaaactttgactttgaaaggaatgtgagttatggaatgagatatcctgcctaagattaaaattgcattgctgtgttttgattctgctctttgaatggcctgagatggataactcctaagagtaactgagtgaggaggacagaaggtgccactaccctcccatccaacacagggaagcaacgttaaggctctgtggagacaatcaaaaggcagcctcctgttggagagcagattagcagctttattgtccaggatgaaggatgcaaatagctcttttttcgcgtgtctaaacaaaatagccagagaaggtggttaaggcttcgggtaccaaaagtggtgtatgactcagactattggattttatgttttggaaggctcatgctctgagaagcagcaatatatgagaacaaggctgaaggactgctgtaaaggaccctgtaacagtggctgaaggatgtaccagaaaacagaggacctgactctctcatatctagcacatatcttagaatatgcccagatcacccagtgctatgtaccagaaccctttatcatggtcacaggccaaaatgtctcatacaaaaagccatacagtgccctttgcactttttctaaatataaacaggaaaataatcaaaactatttttagcttacatggaagaatatctcggtatctgtttttttctctgttgcttggttgattcccagagttgaactcaccaggcagattcttaagttctaaagcctttaaaaggttaaaaatgaataaataaataaataataaattgtgtatttactataaccaataaaaaagaaaaaaatatgcctttgtttagtgctcatgatccttaaatccctatatgacatgacctgctatttaatgtgttgtatgataagtgaagctagatcctcatttaaaaagtgctatataaaatatctcaagtttcacatgccaatcaatgagttggttaataagaaaatgttaaactttctggagatactttccacttgaacttcattttcttcttctttcataaaaaaggaaatacaagctattcatttctcagaacctacccacagatctatcattttataaataaaaataacaacataacaacaacaaaaacatataaacaaaaaatatatacaaacagtctcacaatttacccttcccctttgaagaaattatagttaggaccctaagaatccttcctttcaaaaaatttctttaccaagtgtgaattcaacaaacacttattacacatttagtaggtacctggccctgtttcagacactggaatacagggatgaattggataatggcctcatccttaaggagtgaagagagtagttagaggacatgtaatcaaataccatgtgaccaatgtacggagacagtagtataaatgacagcactagattgcacctaaaagtcaagaagaaaagctcctcaaagggaaatagcccttgaactgggccttagtgagtcactggaagttagcatatgaaaaacagtgtgtatttagaaggaaagaggagagaaggtgaaggggtggaaataatggaggcatacatgtccctttgggaaactgtgactaatatggtaataagagcacaaagcacatgatctagtccaacaacagactaaaactataaaatatcttgtttcatatataaatgaaattaggaggtagctagtcatactttattagaatatttgtggagaaagcctgaaaatctatacattttcaaagctcttgggtaactcttgtgtagccaacctagcaaccgctgccatggggaacaaggagcctgtgaaggttttaagtagtacaataaaatgatcaagtctttctgaaaatcaattttaaaattaatctggaaaaaattctgtaggaagaatgagaaaaaattcatttatgaatgaataatgatggcagatgagtctcattagatgttaaaagataatatgaagctatgctaattaacagaacaataccaataaaggaataagaaaatcagtagaaaaagtccaagaataaattaaaatatatgtaaggctctagtatatgataaaagtggcattttacctcactcaagagaaattccaggagagtcttgggacaactggatagttatataatgctgagtccctatcaaacatcttataccaaattaaattctagctgcatcaaagatttaaatgcttaaaaatcataaaggtactagaaaaaaacatgaagtaattattacaatcctagagtaaaagaagcattcctaaagagcacagaaagccccaaacccagaagccccaaaagcaaagattgccatatttgaccactaaaaatcagctatttcttcacggtaaataggcatgtgtgtgcacatgcatgtgcacctgtgtgtaacacaaacaacagcagaaaaaatactacgtgtaagacacacaaaggcataattttttccttaaagagttagtaatcggccaggcgcggtggctcacgcctgtaatcccagcactttgggaggccaaggtgggctgatcaccttaggtcaggagtttgagagcagccctggccaacatggtgaaaccctgtctctactaaaaatacaaaaattagccaggtatggtggcaggcacctgtaatcccagctactcgggaggctgaggcaggagaatcgcttgaacctgggaggcggaggttgcagtgagccaagatcgcaccactgcactccagcctgggggacaagagcaagactcatctaaaaaaaaaaaaagagtaaccaataagaaaaaaaaaaaaaaggaaaatggggcaaagaattgaaactagcagttcactgaaaatataaaaggcttaaaaacatatggaaagatattcttttgttctcaaataaataccaattaagtaatcaataagaaataatttgtcatttaagagatgagaaaagatccaaaaaattgatagcccaaaatattaatattgtctttctaggaatttgttcaaaaaatatttaaatatatgcatacagtatatgaagagagatgaccgctgttcataatagcaaagactagaacaacctaaatgtccaaatgttccatggtagttaattatatggataagtaccctaatttcagaaattaaatattaaataaattaaggtacttatccatataattaccatgcaacacttaaaaaaatgagatactgctatacatgctgataatatacttggaaattgtatctaggaggaaaacaaatttaaggatgtaaagtgcattccgacaaatttttttaaaagtttgcatgacaaaatgacaaaatgaatagtgtaaaggggccctagaaagtcttgagagaaagagagagactttctattttatatccttttatgctatttggctttttttttaaccacgtacatctattactttaaaatatatataatatttaaaagtaaaaacaatgtactagaaccaaataaagaaagaaaagaaaagaaaccctctggcaatgatataaaaaaagaaatcacatatagactttcgttaagaaaatatttaccataaattcctgcatgatatcatacgctgctgttttttcctcaaggattttcaaacaatccttgatggctgtctgctcatgaaaattgaatattaatggccgaatctgagccaactgatctagttctccttcagaaacaattttgcgcgtatctaaggaagagaaaaattcacatatgtaagttactggtatatatgtgaagggagattttatttttgtttctgtttctcttaaagacacagccatttaagggtaaacagaagtttatttttccacgggtgaagagtctactactttgaaagaggcttcctttggaaaaatcatggctatttacaccttgaaattatacaaaatccactgcccttggagaaaactgttcagtgccataaacataacgaatgctgtggattgagaagtgttcagttttataatgtgaattgggtatatggattgaaaattatgccaaggcaagaacgtccaaggcttggattaggaaagagaacttttgccctccctgggaccaagtgtttggaagttcctagagtctgagatgtggtgacgtggagagttcacgtcctgtttcattactctgaaacagattgaacatgaacgcacacacgtgcacacacaccaaggatggagaggatctatgcaatataattaataagatggaataatggatacgtatggacacttgcaaccaataattggggagaacattctattaatatttaatagcacacatacaatctttttatttttaattatgatcttttaggtaatgttgacagtcaaggttccaaacatctgaaattttatacattatgtccactggccaaaatgcaataaatctagaagtcaacagtaaaagagtattttaaaagcttcaaaattttgaggtaagatgttcaagtaaaacaagttctcataatctctttgcaaagccaaataatgtgaacaataatcaagttaataccagcaaaaagatatatacaaaacaatatagcaaaagaaagaggtggaaatttctaagaatctgcacattcctgggaagcacatcttatcttggtactccactatatccagaggctctttgtagggttggaagtgagggctcttggttgggatagacaggcacagaaatcctaaaatttctcacaaatatccctaaccttagtatgagaggaggtctaagcaggctggaaggggagataaaattcccacaagcgtagaagccattttgatcatctttgatgcccaacagaaaaacccttagatcttcccattgtgttccacctttgctagtacaaaagctgggagaatgaagagagaaaaaaatgaaaatgtagaatgactgtaacaaacactggtgttgactccccaacactgattctacccctctggttagttaaagccatttgtgatcattccatagtaagatccttccagtgaataattcagaaataggtaggagatttgcgccaaccatagaaataggctggtcttgtaaaaaagagaagcaaacctctcttctaccctcatccctctgtacagacataaacaaagaagtataaggacctaattatcatagtctgccctcttatggccataaaaggaaagcgtatagcaaatgtgaaaaacataaagaaactatgttcttgatgacattagcaactgatcatattgaacctggaatccttcctatctctgggcttccattatggtagaaaatatatatatctttatcattaacatcattctgaatttggtctctttttcttgtagcctggtccaagaattccaatcaaagtataaaggtgaggtttcagctgtagatcctgggaatcatttcagccagtttacagaaagggatttgatctagctatttggtgttgtatcaccattgtgtgggcttgaagaacagatgcctctctcattatgatccaagaacaacactgcataatggtctgccaagaaaagttctgtctttgccacaattaggaaactgaggaagttggagaccattttttctagccactggctcctagatgacaccacttcagcaacaatggagaaataagaaagtcactaccacaactgttggctctagtaacacatcaccttacctataatgaggaccaggaacgccaagcctgctatgatgcatagcaataaaatggatgcctctctacacatttacatcttggctaagtgcatatgatcggcaaagcccaaataagctaccaggaagtcttgaaaatgtaatttttcatttttctgcctgggccatacaggaaggtacactaggagaagggtgtgactgatattgagtaagggcatctgtgatatctgcttaacatttcagccacaccatgccctttgagtatcctgctccttggcccctatcccttcagcacacttatcattgtcctcgggcaaaataaacaatgcagccctccaaaatacagtttacaagggaagatgatgagatccaaataaaaatggaaatcaggaagaattcattcctgctcaatcaacaaaaccgaagagacagaaaaagctatacatgttcataacaaaatggaataaaatgtgaaacacagaaaaaataataatataatatagcatgcagaataatttttaaaatctattctaaaatggaagataagcttaaaaaggaaaatgaactgtgtatgcaacatctgtcgaaagaaaaagaaaaattattttaaataagagttcacaaggagataagaaaacaatagaatgaggtttaaaaaaattagtttataaacctaagaaaataaaggtaaaactcaaaagtacataattacagcaataatttataattaaatcgaattctgcaagaaacaaagcaggcagttgaaaatcaacttattgccataggacaaaggcatgtatacatacagtaatgaagacaagaaaggtttaaaaacacagtgaaaagataatgcatgtgaggacctcatcagaggctcaggagaaaagctgcagacagggtgaggaacttgagaaatcctccttcgtggggcaagcttgggaaggggaaaaacagcatccacaggaatggcacaaagcatgcccaaaatgcttttccctatttccctaatggaccaaaagcataagaacctgagaaaacgcatgaaactctgtcatcctcaaggcacaaatgaagactcattaacattgggggtagggaagagagaagagcatcctggacccaggccataagatattccctacacctgcagaatggacaaaataataaaggaggtaccgcctgaggccttcctaagactgagactgaacaaggacagcagagaatgtcaccccaaccaggttggcaagcaaggtaatcataagtaagagctctctactgctgggaattagagaagatcatggagaagaccttctctgaggtgcatgtacaatgggaagagctaaagcagagggtggagtaaacactgaggcaaatcctctacatgtaaggtaacactggaggaatttgaagctggtggtgcactaagggtaaccatagcaacatcaaacccaagccctgctgcattactgagtaaattgatgcaactcctcacactgaaggcctaccaacaaaagagtcatgtccatccctatttacctcagcgtctagaacttagctaagaaatactacaatagctcccccttatctgcaggggatatgttccaagacccccagtggatgcatgaaactctggatagtattgaacctgatcgtcatcaactgaaacatatttttgttcatgtcttccacccataaatttaatgccttttccatcttaagtaagcatgtatcatgcactgtggccataactttggcactctgatgtgcaacagcaaaacttggatagaagattcattcttaccataggtctacgcaactttagcatatgatttttttctttccttattaagtcaagaactttcaccttttcatgtaaagaaagcactttacagcttccctttggcatatccaaattgccagcatcactactctttggggccattactaagtaaaataagggttacttgaacacaagcactgtgaggccaaaacagtagatctgataaccaagatgactactagttgactaagagacaggtagcacatagggcatgaatatgctggacaaaggaatgattcactcccaggcaggacagagcaggacagtgtgaggtttcatcacactactcagaacagtgtgcaatttaaaacttattgtttatatctggaattgtccacttaacatttttagtctgtggttgactgcaggtaactgaaactatgaagagtgaaaccatggataagacatttttacttctatctctagactatacaatattcagttttcaaccaaaaaattatagagtacacacagaagtaagaaaaagagaaaaaagttgccaagagacaaagcaatcaacagaaccagacagagatataacatatgttaaaactgtcaagtgatgaatttaaaatagtgataatcaatgtgtgaaaaggcagtgggaaaagtagacaatatacatgaacaaatggagaatttcaatggagagatggaagccataaaaataataaagtggaaatgcttaaagtaaaaaaaatattgtaagaaattaagcatgttattgataagctcatcagtagatttcacagaggcaagaaaagaattcatgaattacaaaatagatcaagaggaattatccgaattagaacacagagaaaaaaggtagatgaggggcagaggcagagaagaagagaccatccaagaactacaaaccaatatcaaacagactaatatattatacctgtaaatggaatcccaaaatagaagagaaggagaattgggcagaagaaatatttgaaaagataataactgagaattttttccaaaatgaatgaaagacaccaagcctcagatccaaaagctcatcaaaaacaatataagccagaagacaattgagtgacaactttaatgtaatcaaagaaaaaatcaaaataaagaaattaagatttcagtaaatacatgactaattataaaagctagtattcttgtaacaataatgtgtaacttcactttttcttttctacatgatttaagagatgactttttcctaaatttattagcctaaaaataaaaaaattatcataactttagattgtaaatcaacattttgttttctacatgagaaactaaagcattaaaaacattattttatgttttggaacacataatatataaaaatgtaattttgtgacaacaaatgaaagagatggggtcaaaactgtcaaaggtccacagtttttttttttttgtattttactgaattaggctggcataaattcaaattagagtgataagtttaggatgttaaatataatgcccatggtaaccacaaagaaaatagctaaaaacaatacataaaggaaattttttaagaatttaaatatttcattacaaaaggcaactaaatacaaaaggagacagtaaggcaaaaaaaaatgaggaacaaaaaagctacaagaaatatttttttaaaatagcaaaatgacagaagtctctccttatcagcaattactttagatataaatgaattaaactcaccaattgaaagaaagattggcagaatggattaaaaaataaaaacatgatccaactatacactgtctacaaaggactcactttagatccaaagacacgaataggttaaaagtaaaagaaatattccatgcaaacaggaaccaaaacagagcatgaatagctatattaatatcagataaaatcgattttaattttaaaaagttaaaaatgacaaagaaggacattatatatcataaaaggttcaatacagcaagaacatataacagttataaacatttacacgcctagtaacaatcaaaatacacaaagcaaaaattggcagaaatgaagagagaaacagttttacaataataattgaagatttcaatatcccattttcattagtggatagaacaattagacagaagtaagaaaagggaggacttgaacaatataataaacaaagtatatctaacagatacatacagaatcctctgtgcaacaacagaccacatatttaagaacacatggaatattttgcatgtgttaggctataaactaagtatcagtcaattttaaaacactggtatcacaaagagtatcttctcaaaatacaagagataaagttagaaatcaaatataagaaaaactgataaacttacagatttgtgaaaattgaacgacataattttaaaacaccaatggatcaaagaaggaattacaagggaaattagaaacatttagaaatgagtgaaaacataacacaacatatcaaaactatgggacacagcaaaagcagggttaaggggaaatttatagctataaatgcttacatgaaagaaacaaggcctcgaataaacaaactagctttacaacgtaaggaattacaaaaagaagaacaaactaaacctaaagctaacaaaaggaagaaaatagtaaagattagagcagagatcaaaatataaaatataaaaaagagaaaaatcaatgaaaccaaaagcaagttcttcaaaaatatcaacaaaatgatgtgatgaacctttaattagataaactaagataaaaagagaaaagactcaaactactaaaatcagaaataaaaatgaggacattactaccaattctaaagaaataaaaaagattataagggagtactatgagcaattgtatgcagaaaaactggataacctcaatgaaatagacaaatttatagaaacacaaaacctaccaaaaccaaaccacaaagaaacagaaaatctgaacagacctatgactagtaaggtgattgaataagttatcaaaactatcccaaaaaagtaagccctggatccaatgccttcactgttaaattctatcaaacatttaaaggagaactaacaccaatacttgtcaaactgtttaaaaaaattaaagagtagggaacactccctaacttaatctatgaggccagcattatcccaatatcaaagccagacaattatcctacatgaaaagaaaactaaaggccaatatccatcttaaacattgatgtaaaaatcctcaacaaaatagtagcaaagcaaatatttagcggcatattaaaaagatcatacaccatgactatgtgggatttattactggaatgcaaagatgacttaacatacaaaaatcaaggtaatacaatacgctaacagaaaaaaaggcatgcttatctcagttgatgcagagagagtatttgacaaaattcaacatcctttcaagaatatattctttttgagacagagtttcactgttgcgcaggctgaagtacagtggtgtgatcccagatcactgcaacctctgcctcctgggttcaagtgactctcctgctctgcctcagcctcagcctcccaagtagctgggattacaggcaactgctaccacgtctggctaatttttgtactttttctttagtagagacatgttgcctagggtggtcgtgaactccccaacctcaggtgatctgcctgccttggcctcccaaagtgctgagattactggcatgagccaccatgcctggcctatttgtttgtagaaaaaaaattcaacaaactaggaacataagaaaaatacataaacataataaaagttatgtatggaaaacccacagcaaatatactcaatgttgaaagagtaaaagcttttcccctaagatcagaaacaaggcacggatgccacttttgccacttctatttgacataatattggaagtcctagtcagagaaattaggaaaaaaaagaaataaaagccatccaaactggggaaagcaaaaagtaaacatctctgtttgccaatgatatgatattatatgtagaaaatcctaaagattactggattttacacacacatattcacacacacacagagttaaaaaaaataaattcagtaaagtagcaggatacaaagtcacacacaaaaatcagttgcatttatatacactcagatgaacaatctgaaaatgaaattaagaaaacaatttcatttacaataatatataaaaagaaataaaatactttgaaattaacttagccaagaaggggaagggaaagatttgtacaaagagacctataaaacattgctgaaaaaagaattaaacaaatatatctcatgttcatggtttggaagatttaatatcattaagatatcagtactacccaaaacgatctacagattcaatgtaatccttatcaaaatcccaatgactccttctgcagaaatagaaaaactcatcctaaaattcatatggaatttcaaaggaccccaaatagctaaaacaatcctgaaaaatatggggaaaaaagactcacacttcttgatttcaaaacttactacaatactacagtaatcaaaacagtctggtacaggcatagacagacatataggccaaaggaatagaagaaagagtccagaaataaaacccaaattattttcaaaaaagttatcaaggccatttaatgggaaaaacacagtctttacaacaaatggtgctgggaagctggatatccacatgcaaaataataaaattggatctttaccgaacgccatatacaaaaattaacttgaaatggatccattacctaaatgtaaaagctaaaactataaaactcttacaagaaagcatggcaataacttcaagacattggatctggcaatgattccaaaggtacaaacaaattttaaaaaatataattaataatactgaaatatacacttaaaatggataagatagtaaatgttatgttatgtaagatttacaacaataaaaataatttggagaaaatacctctaagtaacccacagatcaaaggggaagtcataagagaaatagggagacattttgttaaaaatgtgtagattgtattttttagaaaagttttacatgaaaaaaaaatgagcacttagaattcccatatatcccctgccaaagtttcacttattattaatgttttacatttggatggtacattcattagtattgaaccaatattgatacatttttgttaactaaagtccatcctgtattttggttttcttagatttccttaatatctttttactgtttcaggagcccatctaggataaaacattacatttagttgtcaagtctccttgggcaacttttggctatgatggcttctcagattttccttgtttttgatgaccttgataggtttgaagagtactggccaggtgtattcttcaatgccttactattgaaatttgtctaattttttctcatgattaagactggggttatgggttttcaggaataagatcacagaggtagagtgccatatttatccatagtatcaagggtatattatatcaacatgatgtatgacagttgatggtgaccttgatcacatggctgcagtagtgtttattaggtttctctactatgcagttattctttgtactcctctggccatactgtactctttgaaagaaagtcaatatgtgcaacccacacttaagaggtgggaaattatgatccacttcctttaaaattgaatattaacgtaatttatcaggaattcttctgcatgggagatttgtctcttcttccccatttattaacatatttaatcatttatttatatcagtatgaactcatggatgatgattttatacttcatactataatccactgctacattagattgttgttcaaattgttccaccttttgctacttagaatgagaaaacattataaattgaatgaaaataaaaacacctcaaaatgtgtgggatgcaactaaagcagtacttacaggaagatttgttgtattaaatacttgtactactgttgtccctctgtatttgcaaggaattggttccaggacctcccacagataccaaaatcctcagatgctcaagtcctttacacaaaatagcatagtatttgcatataatctaagcacaccctctctctcaaatactttaaatcatatctagattacttataatacctaatacaacataaatgccatgtaaatagttgttatatttttaaaatttgtaattttttgttgttgtattgttatctttgttcctaaaatatctttgatccatagttggttgaatttgtagatgcagaatctacagataaggagggccagttgtatttatgaaaaagaaatatatcaataatctaagtttccaccttaataaattaagaaaagataaaataaaatccaaagcaagaaggaaaaaggaaataataaagagcagaaatcaatgaaattgaaatcaatgagaaagtaagggaaactaaaagctagttcttggaaaatatcaatagaattgatacagtctctagccaaactgatcaagaaacacagaacaaagacacattttatgaaattgaaaaaaaagagaggtgatcagttaagataagacatcaaaaagttaatgagggaatattacaaacaactctagtcccataagttagacaatttacatgaatgggacaaattcactgaaaaatacaaactgccaaagctcattaaaaaaaagagagacacctaaatagtcctatatcaattaaataaattgaatattgttatgggctgaattgtggcccatatgtggccgtatttggagacagggtttataaagaggtgattaagttaaaatgaagtcattagaatagcccttaacgtaatataactgatatccttataagaagagattaagacacagatatacacagtgggaagaccatgtgaagacacagaggaaagacggccatctgcaagtcaaggagagaggcctcagaagaaatcaactttgctgacatcttgatgtttgactgctagcccacagaactgtaagatccattcttggatattttgttataaaagcacccccccaaaaaaaaaaaaaactaaaaactaaaaactaacacaaatatgtatttagaaacctcacaaattctgggtccagttggcctcactggtgaattttagcaaacatttaaggaagcaatactaccaattttatacaaacttttccagaatattgaagaggagaaaacacttcccaaataattttataagggaagcattactctgatactaaaaccggaaaaagatatcacaaaaaaagaaaattacagatgaatatctgtcatgaacataaacacaaaaaaagtcttcaggaaaatactagcaaatcaaatcgtaaaacataaaaacaatattacaccatcacaaagttgggcttatcccaggaatgcaaagcaggtgagatatttggaaatcaaccaaagtaactcatggtatatcaacaggcaaaaaaaagaaaaactatatgatgatctgaatagatgcagaaaaagcatttaacaaaagtaagagtccattcataataactccgggaaactaggataataggaaggctcccttaatctgataaatggcattcacaaaaatactacagcgaacattatactttatgatgaaaaacagaatgctttctccctaaaatggagaatctggaaaggatgtccactccctttcctcttattcaacattgaaccaaaagtcctagcgaatgcaataagttagtaagtcaaaaaaaaaaagaaagaaagaaagaaagaaaagaaatgaaaggcatatacattggaaaggtagaaaaataaaactgtgtttattcaccaacatgagtatctacttaaaaaaattccaaaaaatatatttaaaaggccctagaattaatgagcatttaggaaggttgaaggacacattggtaatatacaaaaatcaatcatatttctatctactatcaatgaacaatagaagttaaaatatttttcataagtctcatttacaatagcaccaaaacatgtgaaatattagatataaatctaacaaaacatatatacaatctatatgttaagactgcaaaacaaacaaacactgatgaaagaaatcaatgcagacctaaacagagtgaggaatgcttccgtcaggagaaacaacaacaaatccgttaaagtggaatttgagaacgccaccaggacattttgggttcctcatatgctactgaatcatcagggaaagggggattactacactgcctagtgtgctggattccaagtattaaggggaaactgggctgctgctttccaatggagtaacgaggaatacgtctgcaatgcaggtgatcctctagggtgtgtcaaggtgattaagtaaacagaaaactagaaccacccaatttaggcagaactactaatgacttagatcttgaggaatgaatgtgtgggtcaccctatcagacaaggaaccacaaccaaatgggatgtttgctgagctgaaagagaataccagacaggtgtaagacggcagtgatcaaaaccagatacaaccatgtgaccagctgcataaacagggataaaatattgtgaatttttctttcttttttgatatgcatattttatacatatatatatatcatatttttgttttcttttaaaaatattaaagggaatgtgaatcagttggaaaagaaagaatatcactcaagacaaaaaagagacacttttggagaaggggagagaatgttttcagttgtacacagattagttttatcactgtagatgcaagcataaggttgtccttatttggatattaagtaacatttaaaagggtgtatataggtgccaggctgatacagggtgaactgtgatagctttataatatgttgacatggctaggctggaccacttttcccagaattctgttctctgaatgtttccagctaaaacagggcacaagcgaggttctcatgtcagatctggaaggtgaacatggggcagcagctattctgtgctcagatgcactatggatgatctcctgactcccctcattctatatgtggaaggaagaacttaaaatcacaacagtgccaatcctacctgaatgaatataactggcatgtcattctatctaaatttcaaacaagtttacacaggaatgaacaaaataatttaaaatcaccgatgcagcaaaaacttgcccaaatagctacaaaaatgtattttttaaaaaattagagggaggattttcctttccagatatatttagaataagtagaatcaaaacagaataatataatatgtccacaggaacaaacaagtcagttagtgaaaaaaaatttagagaatacaaaaggatcaaacatttttggaaacttaatatgtgataaaagtatatataaattcatttgggaaatgtggtttacttagtgaatagtgctggtataactgtccagtcatatgaaagaaaatatagttttctatacccctataatatttagcaataaactgcagatagattcgtgatctaagcaaaataagtgaataaaaattctgaagaaaatttaggagaatatttgcatgtttttcctgtaaagaagacctttttaaacattttagaagttaagaatgttcatgaaagtctcccttcttaaggtatagaattgagggttacaatttatagcacatttgtcagacagacaacatgttaagatttccaacatgtgaagagttcctacaaattaataagaaaaacaatgaacaaagtttataaatatgcaaatccaagaagaagttaataaacatatattaagatacttgatcctagctgggcacagtggctcacgcctgtaatcccagcactttgggagaccaagacgggtagatcacaatgtcaggagttcgagaccagcctgaccaacatggggaaacctggactctattaaaaatacaaaaattagccgggcatggtggctaagcttttggaaaggaatctggtattgcccattaaaatataaaacgaacataaactttgacttaactatcttactttagggaatctaaccaaaatcaaagtaccagtacttaggaaatacgtgtaaatatatatattgcagaaaaagtcaactggagaatgggtgaatatattatggtatttccatacaatgaaatattagacaactattaatcctatgtcagaatatgtcttaacctatataataatatagtttaaattttaaaaactatggttgcagggtaattgtagagttgcagagcacacatcaatttttatttaaactttaaacagaaaatctgtttttatatctttgtgtattcttagataaactattatattggttgcctctgaaccaggattcaggatgatgggaggaaattattaactttttctctatatcattctatattgattttcactaaaatattagcatacattaactttataatttaattttttaaaattttggcttttaaaatattttattaaatgttaaataggtacaaaataataattaagtaaaatatctttaagaacaatacatacccaatttaaaacagaacattagcccctgatgctcctgtgtccccttcccagacctcattccttgtcctcctccctcagggaataatcactattctgaattgtactatcattccttttgtttgttttgtttaccctttatgctgttttgcatatttcacaaatttatatagattacattattttgttttaaatcttgacttttttgctaagactgcatctgggtttattcatcttcacattaaacaaaatacaatatctaattcatacatgctggtgttgacagatatctgagttgtttacagttgaagtctattaaaaacaagcctagtatggacattcttgcatatgtcttctggtagaaaaaggaaagagtttctctaagctaaataaccaggaaggaaattgctaggacatatggcatgtgcacactaaaaaaataccaaattattttccaaaatggtttccatcaagccacatactcaccaatatcaactattatcacatttttaaaaatggaaacaatctagtcagtgtaaattattatttcactatgatttaattttcacttccctgattcgaaattaggttggaccactttttcatattttctcttctgtgaaatgtttgttaatgtgttttgcccatttttctatttggttatcttttacttactaatatgcagtttcttatattttctaggcattaatcctttgtgagcatagacctcagtaacagaccctaggaggagcctaaccatagtcctaaactgaaactgaaaaggagggtactaagaaagaaaaaagcagtgtctatctacttttccctaggaactggccttactctaacagctaagaaatggtatttcctgtttgcaaagtaatgtgttcttatttttattttaaaaatatatttatattcaaaattccacttctgcctaaatatagaaagctagtatgagcatcactcctaccctaacaatatacataagttgaaaaaaaaacactaaatcaaaattttattgaacccattagagagctgaggttgcagggcaaccaagtagtctgcaatctaaggaaagacagactctcctaaggagtgacaggacatgaacactggctccctgtggcagttcaagggagaaagagataccaggcactatacaaatgggaaagaagtattcagacataaaatgtaatgcactgctgatagctggatgtgggccagtgtgacagtacagaacagcgtaaagccacagacacaaaaagaacttgcacacattcacagactcaagttcacagacctccaacaggtgctcataagaaagactgagagcagagcaggaaacgggaagaaccattccctcagaagggtaggcttggaggaggggagccactgtcatggtcgaaaatgcgtaaagccccacttagacctatttctcccagaacaaaagccttacactgcaggaggaggagcagcaatccctgctttgtataagtgtatacccactgcagttggaaacagagcaaacaaaatccatctattcctggagaaggtgcagaaaacagtcctaagcccaggatttaatgccattattattacaaaactcctaccactacactaagtgaaggggaggaaaccttctccactgtagacttgccaaaggtgtcaggcagagtctggatgccatgagaaggggtagtatcactaaccaagcctgtcactgaggaccagggacagaggacctgcccaaggctgagaatggaataggacaacaaagaatgacttggccctccctccccaggcacgcaagcaccagtctactgctggaagataggcaggagaaggaaagaaagcccttctaaagcacaggcacacaggggaggcctaaagctgaggacgaaacaggaagagaccaaaaataaaaactccttagcaccccagctgacaccctgcgcacaagctaaatcctaaggaattctaagccaatggttcaccataggtaatgagagcaacacaaaaccaaaacccagctcatgtcctaaatggcctaccagaggaataggcatgactatttctaggcataaattctatttactttagtctctttttttctacacccagtaccaacactcaatcagatatatagacacataatgaagctgcagcagctgcaacaacagaagccagtgtcaaaaagcaaagcaatcacagaaaaaaatatcagcaacaacccatctgtcagagttatccaccagggaattttaaataactatcattaacatgttaagctctatgaaaaatgcaaacaaaacgcattaacaacagagacggaatctgtaagaaggtgtcaaatggaaatgttgtacataaaaaacactgtgtgctttcaatgggttcattagtagacttgacacaaccaagaaaggaatcagtaaacttgaagaaaggttgacagaaattacctaactgaaatacaaagagtaagaagagtaggagaaaagaaaagtaaaaagcaacaaataatgttagtacagcttctttggaatacagtttgtctgttatacacttatgacccagcaatcccactcctagatatttaccttaaagtaatggaaacttatgtttacacaaagtttgtgaatatctgtagtacttttatccataattgccaaaatctggaaacaacccagtgtccttcaactggtgaatggaatactattcaataaaaaagaaattaaatactgataaatgcaatgacacagatgaatatcaaaagaattatgctaagtgaaagaagttggactcaaaaggctacatatttatgattccatttatacaataccttgaaaaagacaaaagtaaagagaatgaaaatagattactggttgctaggcaccggtggtagggtaaagggttaactataaaaaaatacaagagaaatttggggggagatagaaatgtactataccttgattgtgatggtaaaccttggtcaaacctcatagaactgtatgctaaaagggtgaattttactgtatgcctcagtttaattaagcatgttttaattaattaaaaattatgtctcgttttataaaagcatattcttataaactatttttgtaggagatctgcattttaataattgcataaggtgatattttcttaactggatttgacatttttcaaataaagtcattagagaagatgtttccaacatttgatgggatgttggttatggatgacctctaagatcctctccaactccaaggtttttgaggtgtgcatgtgatcccccaagtttacaaacacaaattttataaatatatatatatatatatacacatacacatatatgttaagtatatattcatagttctaattacatttatattatatatacatgtaaatacgtatacacaaaaagttctgaaatattcttcagtattataatttattatatatttgttattttctttttttccactataaacatgtgataatttgtaatccaaaaatgttattattttacttacaaagcatatattgtgcaacaaatttttaaaaaggaaataaggaagcaggttatttttcaaatctataaaatacctagctttaaaaaaatggattttactaaactgacatatttaatactttaaaatacttgaagaaaggacaggaattagccattgtgaatatggggtgtggagcatttttttaattgcatttttttatttttaaaagaaaatcctagaaaaccatattttcccatttttgaagttttccctagctctttctttcatttgtattagaaatatctttgtgcatatctctaaaatagagcctcaacttgctactacaaataggatgatgtcataccagaaagtagaggggagagagcctgtgatggccctgcagcctcctcatcctcactgctccacctgtctcttctgaaggggcctctggctgtccacatgctgggatcactgccactagaaaagaaatgtatatatttgcccatggtttcaaagaatatatacatttgagaaatactttctaatcatcttcattgattatttaattgacattcatttccatttcaattcagccacccactcccattgtcatcacctgaaactggcccacttgtgaaataattcccaaatcccaatatctgatcacaaactccatctcctcctactacttttaccttgcaaactagtcgcctcagatccatccacttatttaccttctcccctcctttacctagactgtgggagggaagtactcgggtcactgggctttctaatatcggcagagagccgtttggaaaataccagcatgtccctggttggtttcctgtaccactcttccatggcagcaaattccaagccaccatcttgttatagtccttattttaatactctctctgacttagtaaaaatgtaacttcttctagaaaatgcaagccagaaaatagaaattctttcaatttattatcttttaaaacatttacttagatgcatcaatgtctttcttattccttgctttctgcctgttcaaaattcctccttccgtgttcttaaccagattccttctgcctcctctaaggtatttttctataacttatttttttttaacatatcgtgaatttctccctatctacaaattctttcatatcataagaatacacaattttctgtatcttaaaaataggaaatgctttaaactctgtctagctactaattgttaacagatttttcaaatcctagcccatacccactttgtttcctttgcaacgtctccatactcaactgactcgctaatgctattaacttggctcttgttgcactttcatttgcaaccctacctagcaaaatcctcctaatttgacttctgcatctaaccttcaatgtttagagaaaattcttcctaaaatacaaacttaattacacctgcccaccaatatcaggataaatcaaggccccttatcagacacaaaagtttaggatattggccaggtggcctctgtctatttttccatcaccatctccactgatttcctacatgcactgtatgctttaaccttagcaaaataagtgcctttttcttttacttctgtaagaaaattcgggtttcttactcttttctccttctaatttttttcttggattactgtaaacatttaattaatctccactgactgccacttccagctatcctcaccttgccaccagcattcctccttctggatggataaatagatagttgcatgaataaaacaaaaagaccctccgtatgcatccttttgattttaacagactgaataaaatgtatactcagcttcacatatatggcattacttccctctccagcccacactgtattttgggctccacctctcatcttctgcagcttcctagcattccacctcacatacaccctacgactcttggcacctaatatttctccccattacccctaagatattttcacaactccttaccctcgctcaaacttctccctcttgcctgaaatgttcttctctttttcacctgctaggtttctatttaattaaatcctaaattcaaccaaaatatcttttcttcaaagaagcttgtgggaaacctccctcatgcatagtcaatcttctgtacccacaatctttggatttttactctaaaataatatttactatgttgtacatcaatttgtcttttatatgtctgtttccctaattaaactgtgaactaaagagcaaaaaatatatagtagtttgtatttgtgtacagtgcttagtgtatcacagaatctcaaaatgtctttggaattactattatttgtttaatgcacttctgaaaattgtacatataaatttcatacaatacgcatacaaaaacacataatataaagaatatacacattcttatacagtgctattccagtgagggtagctaatattactgataaatctctaagaaaatatggcttaacaaaatgtttcctcatttgatgtttttgcttataacacctaaatttgaacattttataagcatgaaaacttgtttctttgttttcctaatggaaatttactgttcttcaggtactttaaattttttaaatatatactaccagaaattcaccatactaataaacctgttgtttataccatataattttctttctgaaaacagattacatttctaataacatttagtgctgtaccgtgagcttcatgctacctcaagtacactgaccacttcaaaagctccaagcatatttgcaaaagctttgacgccatgtaactattgagaggatagagaaatcgaatccttcaagaatacttttcccttatgttaattaccatatttttgagatcataaacatatttctaagaaagctaaatcaagtttataaaaagctatatcttgaaaaattaaacatttcagggccattattcactgtctccatgcagagggctagctatgaatataagtagcataaacagaaaacccactaaataagcatattagttatacctttctgaaggctcttcaaaaacatcctcataatcattatgtgggaaattccgaagagaaagttttaccttctctgaattaactttattttcaaaaacctacagacataagaaaggaaacaaattatagcactggttttagaaaaatatggtttaaaacgtgatttctatagctacttaagaagagcaaaaagatctgcaataatggaattataaccacaatcacatagtataatgtctgctcctagaaaatcacttaattgtatatctccctattaaatatcttccaatctgtcaaaacagtgtagagtactatgtaaacagaagttatttatattgaattgctcaagtgatttttcaaaactaaatttttaaaaagcttcatttgagaaaaaatagatttattacttcagcccagaagagattttcttataagtgtttaccatgttttgtttactgtgaatataaaattcctgccactaaatttatctttactttagtacttgcaccatctaatctactaattctaagtatttctccacattccactgcccaattttgcaccgggcagtggacttcagtcttgataactcgcagtgccagtgccccagccaccacatacacgtttccttccttccttgtctaatactgtcttgccatacttggccttctattttctcaagaacatcttttgaatcagctgatcaaatctcattcacacacagaaataactttgggactattattgaaattaagtaatatgaattttttaatttaaattggaaataagtgatgtatttatatattaagtatcattatccactaatatgatatagctatccagcaaaaagattataaaatattctcaataaagacaatgtataccttttcttagatttactcctaaacaccttaagtggcacaattgtaaatgtaatgtcatagagcagaccttttatttgatacacactgctcaatccacaaaccacatgtttttacatctagtatttttgtgtacattccattctaaatactttaaacttccattatgatttcttctttgactaatgagtttgttagtgtttgcttggtgtatgtttaatttttactttaaaatcacaggaaaatgtccacctaagattccttctcattaaactatgtagctacaatacacgaaatgaaatgagcttcacagaattgaactagttttgaaatcagcactgattggcaaatccctaaaaattaatttcaggataattaaaattgaaatgtagaaagtgtggctccagtgggatggaggaaaagaagtgggacacatgctattacacaacatgatcccacttccctcttacgagacatgcttaaaagtcatttgagtacaattcatttacttagaaaaagtgatatctggaagtcctaacacaatttaaacctgagacatctttcagctcatggttcaaaatcaaatggattatatttattttttaaagaagcagactgttccagatggctgcaattcaaatttaaggctgactaacatatgtctgattgagtgaaaagtgattttgctaacaataccaagaactaacaaggagaaatataataaattatcaagatggcaggacttttggagattgctcacggaatcaaattaatatcaaattttttaaatgttagaaaatgttttctgaggagcctaagttagcttttctgtagtccatgcagcaaggatttatgaggacaaagtgaaaacagtaacacagataggagcctggtttctagtctgtgactcaagagttatatgatcatagacaaatcgcttcagctttcacctctaaaatgagtgctggcataaaaatgtctttaacaggccaggtgtagtggcttatgcctataatcccagcactttgggaggccaagacgggtggatcacctgaggccaggagctcaagaccagcctggccaacgtggtgaaaccccgtctctaccaaaaatccaaaaaataaattagcctgtctcaaaaaaaaaatttctttatgctccaaatctaaccaacttcaagtctatgagtctagacaatttctaggggacagcatcatatctgaaaggacataaaaatggctacagtatcaaattgtttcatgaaacataagaaaagcaagttctaataaaatcaggtaattttcccaacactataaaaaccatccaggaatgttctaagatccttttttatgaaaggaaactttaaagcatatcagaattcaccctagataggccaagctataacttagcaaaaaaacaaacaaacaagcaaaaaaaaacccaaagtaaaaatataaacaaaatcacaaaatgtgctcagttctagaagaagtcaaataagactataagactatataaaggatatacttgggccattctgtgaaggtgctccctttcaaatcgtctctgcttcaaagagaaaaccattctgatcagagaaaagaatcaagagtgagcggagagcccaacacggcactaacagccagagattcccagccaaagatgtgatggtagccttgatgtggccaacttaagtatagcagagaatggacaggagataataatcaagttacaacactgttcttaaaagctgcactcctgcccacctggggtggaggtggcaattgaacaggggaagtggtaggagcagtttttggtctatgtactgactttatctctattactcctgtaacttacaggaaatgaacacaaggccagcatcatcatcgcagttccaaagctccagttgactaggtaagagaaaaaaaaatgcaaagcacccaccagactaaaatgcatttccctttttttgtgctctaaccctagcactatctccacaaatggggtaatgtgttgaagtaagaggttttgtcacagacttttcacagccctctacttttccatagttcggagacacccaatcatgctgtctcaaacaatgaaaaagtccacaatcaatacatctaaaggtgcttcatacttcatgtgacatttattttgtatcttcattagtaacacaaaactagtgcctgtaaaatttccagagtagcattagaaaatgcaattcattagaaactttgcaaaaaattccactctttcaaatccccattttggtcactgtcaacactacagtgacaaaaaattaagaaatcattttggtgagaaccaaatagatacccatttcccagagagcacagtcagcaatttaggtattagccaaaattagtagagatccctctccttttagtcttacctttgatctaggtgtgttttcctgacttgatgaaggcaaagtctccctgaaattcaagtcttctgcttcagagtcatttccctcataatcgtttactgaacaaaggcggggggaaaaactgatcaaatagaaaacactatacagaaggaaaaatggagccttaatgagaaaaaacaagctacatgaggggcattttcatctacttttcctgttttccaaacaccccatctttatctcctatggtaatcatctctttctcccctgctttgaaaaaatcaacatagcaaagctgatccttcttctaggattatcctcagggagttgacttttgagcggttcccttgttcctcattgccatattattcaagaaagtactcttcaagtaaatcctagatatttacaacctgcagaacctatgcattgggatctacagaatacagtcttctgtgtttcagagtctatttcttgaataaagaatactgtgttacaaatgtcgcactgtaacttcttgtattatttataattcataagttagtaatatgttaaattatacagaaaattgttttcggctttgttgaataatgtaatatgaatcatcccaaggaaactctgggtttcttatatgattattcctaattactgtgttaattttactgcacagactctttcagataagaagccaagagaaaattttctctgatctcagtactgagcactcagagtactgtttctcataccatgggagccttaaatattatgatttagaaattctatggcatggcatattaccaaatcaataaaaatatagtaaacaagtactatggaaatgaaaaagtgtgttcctgaatgtgtgttaaaaaggaaatctaatagaaattatgaacctttataacacatgaattaattttataaattaaaacattaagaaatatcaatgaagggacaacatatcaaaactaatgtgaagtagctaaatgagtatttagatagagggaaaatgtataggtttaaatgtgtttacaaaaaaggcagaaaaaaaaagctgctataaatgagttttgtattcaatcatagaagccaaagaaaaactgaggaaacccagagaaactacaaaggagaaaatcataaagaaaaatataataacagaaaataagcctaaagaataatcagcaaaatccaataaactagttctttgaaaaaaaaaacttaaaaatacgcaaccctctttcactacaaatcaatggagagtaagtgcacaaataacattaaaaatgaaaaaggatcgcttctcggccttttggctaagatcaagtgtaaaaatgagaaagggcacagctacagatgcaactctcatttttaaaggtaataagcaaatattatgagaaactttagggaaatctgatgaaatggaaacttttataagagaattataagttatgcaaatttactccagaagatgtagaaagcctaaatagtgtaataaccatttaaaaagtcaaaccaataatcaaaaatatcactcccaagaggaaaaagcatctgggcccaaacaggtttccagatgggattttatcagactttcaatgaaaaaaatctctcatgcaaacggttctgaaaataggaaattccgcaaacctaggaaggagcttcaagtgctagaaaaaaaattaacaggaaaaaaaagtctatgagaattgtaaacaagcaactcatagaaggcgacttacaggccaataatatattcagaaaaagtccagcctcacctgacaaacaaaaaatgaaaagtaaaacaacctacaattgactttcatttatgcttatgagagatttactgtaataggacttaaccacaaccaaccagaaaataggacaaaatatataaaacaataattttcagaccttaaacaacagactgtgatcccagagagaagggggtgagccttctggttgctccagattatggcctccagaagtttgcaggctatagctcaggaaaggaatcaacgagtccagtgattcaatgagttgagaagaaaaagatcaaagttaggagaggctgaggcagccagaatttgtagggcagagtaccagggaggagggagctatacagaacaagagaagtctaagtagctgcaaagaaaccctctcatgtcctttgcagaatatggatatgcttatatgaaggaggacaatctctgacactcaggaaggaccaccggaaagtagcaagccacacaattcctaggaacagttcataggagccagaatgaggagaccctgtaatacagggggcgttgaggatagtgcacagaagagatacctcttagtactaaaactatccttggaacagaagctccttagggccacctataaaaaaggtgaagagcaagcctcagacaggatcaggttaaacttcaagtaacataactacaaggcagaaaaacccaacattctttaaagaaaaatcaaggccgggtgtggtggctcacgcctgtaatcccagcactttgggaggctgaagagggtggatcacgaggtcaggagttcgagatcagcctgacaaacatggtgaaaccccatctctactaaaaatacaaaaattagctgggcatggtggtgcgcacctgcaatcccagctactcaggaggctgaggcaggagaatcacttgaacccaggaggcagaaggttgcagtgagccaagattgcaccactgcactccagcctatgagacagagtgagactctgtctaagaaaaaaaaaaaaaaaagaaaagaaaaagaaaaaagaagaaaaaaagaaaagaaaaagaaaaaatccagcaccaaaatcatataattcacaatgtgtagtaaacaattaacaggtatgccaaggaatagaaaagtataacccacagccaaatcaatcaatcaatagaaatgtacttagaaatgacagatgataaaatttagaaaaaagaacttttaactattataaatttttaaaaggtgctcaaggaaataaagaaaaacatgatacaataaaaagagatataaatcatgtaaaaataagacctactgaaatttctagagacaatgtatgaactaaaataaattaacagcagataaggcagaaggaaaaaaaatcagtgtctgtcaacatacagcaagagtatatccaaaatgaagcgcacagtagcgaaaaaaagagactgaacagactcagcaaactgggacaacatcaagtgaactaaaattcctgtaactggaatgccaaaacaaatatgaagaaataatagctgaagtgttaccaaactagatgaaaactataaaccaacagaccaaagaaggtcaataaaatacaaatgtaatatatgagcttatagaaaaatcacattcatgtatgtcatattcaaattactgaaaagaaaaaatgccagagaaaacagacacattaaatatagaaaaacaaagataagaatgatggatttctcatcagaaatcatgcatgctagaagataatggtgagacattttaaagtattgaaagaacatagaattcttatagaatgtcaatatagaattctataccctgaaaatatatatttcaaaaaataagacttctgtagaccaataaaaactaagattatatccagcctgcactaaacaacaacaacaaaagttaaaggaagtttttcaggcacaaggaaaaggataaaatatgaaaatgtagaactatccaaaggaatgaagagtggcaaaactggaaaatacatgagcacataaaacatactctttcacatgttctaatttctttaaaagataactcaattataaggaaaaataataatctattgtagggtatacaacactcacaataaaattggtatcaataatagcatgaaaggcaaatgggaggaaatggaagtatcttatgttcctacaactatatgtgaaatggtaaagcagttcccgcttacccacagggaatgcctagttccaagacccccagtggatgccgaaaacttaggatagtacttcctgcactgaagtcttaaatccctcaaagtcatccatgagggttaaaatcagtttttcccaaactcccattaatgttgacattttgacctcctcccataaaccacaaatgttcttaatggcgtctagaatggggagttatttccaaaaggttttcaatttactttgcccagagccatcagaagaatcactatctatggcagctacagccttacaaaatgtttcttaaataatgagacatgaaactcaaaattactcattgatttctaggctatggaatagatactaaatcaggaactaactcagtaatttaaaaaaacctaccaatcagaaagagcccgggccagaaggattcacagtcaaattctaccagatgtataaacaagaggtggtaccaatcctactgaaactatttcaaataattaggaagagggactcctccctatctcattccataaggccagcatcgttctgataccaaaacctggcagaacacatggtctaatatccagaacttataatgaacttataaatgaacaagcaagaatcaaacaaccccgttaaaaaatgggcaaaggacatgaacagacacttttcaaaaggagacatacacatagccaagaagcatatgaaaaaatgctcaatatcactaatcatcagagaaatgcaaatgaaaaccacaatgagataccatcttacacaagccagaaaggctattattaaaaagtaaaaattaaaaaaaaaatgtttgtgaggttacagagaaaagggaacacttatacactgctgatgggaatttaagttcaaccactgtggaatgtggtttggagatttctcaatgaacataaaacagaactaccatttgattcagcaatcacatcactggctatatgaagggatataaattgttccgtcataaagacatatgcacatgtatgttcatcacagaacttttcacaatagcaaagacatggaatcaacctacatgcctgtcaacagtggaatggataaagaaaatgtggtgcaaaaacaccatggactattacacaaccataaaaagaatgaaatcatggctgggtgcggcggctcatgcctgtaatcccagcagtttgggaggccaaggcggatgaattacctgaggtcaggagtttgagaccagcctggccaacatgatgaaaccctgtctctactaaaaatacaaaaattagccgggcatggtggcacacgcctgtaatcccagctactcgggaggctgaggcagaagaattgcttgagcctgggagatggaggttgcagtgagccgagatcgtgccactgcactccacctggctgacagagcgagactctgtctcaaacaaaaacaacaacaacaacaataaaaaaaaaaaacaaaaaacagaatgaaatcatgtcctttgctgcaacatggatgtagctggaggccattatcttaagtgaatcactacctgggtgatgagatcatttgttcaccaaaccacagcaacaagcaatttgcccatgtaacaaaccttcctatgtacccccaagcctaaaataaaagttggaaagaactagtctacaaaaaagtttgggtagctttccatgtttttgcatattctagcttaactgatttatcattaaaattagctttttcataaaagtttgcaactgttaaaggatagtttccagaaaaagaaaatcacagctctcatacagacatataaatgcacatgttactttattatattcattaatcagtgagggaatcaggcagatgttatttttaaatttttttttaaaaaacccataatactgtgtgttagtctgttagcatcactacgtaggaatgtctaaggctgggtaatttataaagaaaagaggtttgttctggctcgtggttctgcaggctgtacaggaagcatggtgctggtatctgcttctagtatctaacctcaggaggcttatagtcatggcaaaaagtgaatgaggagccagcaaatcacatggtgagagacaaagcaagagagaaggggaggttccagactcctttgaacaatcagatctcacatgaactgagagagcactcactcatcaccagggggataacaccaagccattcacgaaggatctgcccctatgatccaacatctcccaccaggttggggattacctttcaacatgattagaagagataaacatccaaactataccatacaggaagtccttgccagagcaattaggcaagagaaacaaacaaaaggcatccagattgaaaagaaggaacaattaggcaacagaaacaaataaaaggtagccaaattgaaaaggaggaagtcaaatttgtccctgtttagagatgacatgctcttacaaatgcaaaaacctgaagaatccaccaaaaaactcttagaactgataaacaaattaagtaaagttgcaggatacaaaatcaacatgcaaaaatcagtagcatttctataaaacaataacaaactacctgaaaaagaaatcaagtaagcaatctcatttacaataactacaaaaaataatacctaggaataaatttaaccagagattaaagatctctagaataagaactataaaaaattgatgaaataaattgaggaagacacaaaccaatggaaagacatctcatgttcatggaataaaagaataaatatttttaaaatgacaatataaccaaagaatctgagagctcaatgcaattcctatcaaaataccaatgacattcttcagagaaattttaaaatcataaaattcatatggaagtacaaaaaatactccaaatagccaaagcaattctgagccaagaaaaacaaaaacaaaataaaaacaaacaaacaacaacaacaaaaaaacaagaacaaagcttggggtattacactacctgacttcaaaatacactacaaatctatagtaaccacaaaatcatgatactggtataaaaacagacacatataccagtggaatagaatagagaacccagaaataattccatatgtttatagccaactcttttatgacaaggcacaaagaacatatattggggacaagaaagtctcttctataaatggtcctggaaaaaactggatattcctatgcagaataaacttagactcctatccctcatcttacacataatctgacttacagatggaatccaggctcacaaaagcagatagcagaatggtggtttccaggggatagaggaaggaggaaatggggagttgttggtcagatggtatcaagtaacagttacacaagatgaatacgttctgaagatctgatgtatagcaaaatacatacaatactgtattgtaatgatatttgctaagagggtagatcttatgtttgtaatacacacatacacacaaagaaagaaaatggtaactgtgaggtggtggatatgttagcttaattgtggtaatcatttcacagtatatagacaaatcaaaacatcaagttgcacaccttatgtatacacaatttttgtcaattatacccgataaggattggaaaaacacttctagggagagagcaataataatgacaaggagggcggatagaagagggaatagaagctgggctgaaggtggaaggaatgagaaaaggcataaaagacatactgaaaaatgatggcaagctactaatgttttaagcaagacaatggcaatatgggtcggctgggagacagctgacatttaactaaaacactgcattagtagatgtatcaaaaaccttagaaatgtatatgccctgagttcacagctaacaaaattatggaaacaaacagctttgtggcagattacaggttgtttttattgtcttgttgttttctttgtgttttggtgcttttttgtacttcccaaattcttcacaataaacctatattacatttataatcaggaaaaaaaaatgccatttgaaaagggtaaagtaaaacactagagtttaattgttgttactctaagcgtgatggcttattagaaatgcagagtcttgccccccaccccaccccaccaagacccagaggatcagaatatgcaggataataatccacaggtggtccctatgcaaatctacagtctgagaggcactcctgtagctcctcctgatcccatacccacaaaagtagatgatgcacctaccaggctctgctctaaagtccctaggtgaagacatgttgttcccatcccctaaatgagactggtaaaaggcttcttcagaaaaggagccttagtgtcctgtgagtcaggccaaaggtctagttagtatcctgggggccagcaaacaatttttgttcacctggtaaaacacacaaagccaaagatttttctgttacacaactggagctatcacagctttgacatattattactcatcaattcaaaatatttaaaactgcaattttaattaaagacaaaataaatttcatttgaaattttatcaaataatttcaggatattccttgagaactggagatacgcttatttattcaaataccagagcttaaatatgctataccttgcattccacaaataaatatgtgaatggcccctccactccaatgatgtatctctttatataaacacacacacacacacacacacacacaaattcaatcaatgtcactcaatggaaactcagttatttaaatgccacacctaagctaaattaggtgctgagaattcagtactgaataaataagaattaattacagagaccgtcttcaaggagttcttgttcattcaatctataaaaagttctcacacagaataaatcttttttcttttctaattcttgccataaagggcctgtaaggccatgttacattgctcccattggttaaaaccaagaatacttttatctggagacctttccattaactacctgcaaataaaatggtattactataatctgaatctaaagttaatgtgtgaaacagatttattttaaaaactttgagatataggtgttaaaaaattatttaagactaggtgtagtggctcatgcctacaatcctagcactttgggaggccaaggcaggaggatcgcttgagctcaggagtttgagaccagctggggcaattgggtgaaaccctgtctctacaaaaattagacgggtgtggtggcacacacctgtggtcccagctacttgaaaagctgaggtaggagaatggcttgagcctgggaggaggatacagtgagccaagatcatgccactgcagtctagcctgggcaacagagccagaccctgtggcagaaaaaataaaattaaattaaattaaaatgtgaaagtaaggcaaaagataagtggaatgtcacttcaatgtcataaaataatgacaggccatcccaaagattacttatgtggggaaattgtactttattcagttcattgtttactactgattaaaagtcctagacttaatgcaattacaacgtaacctatagatttttgtccagcagtgatacaaataatttctgtctgataaggtaacactaaagattataatttatttctgtctggcattaaccaggttttcttaatctaatctagcattcttactctaacattggttcaaaacgccagtgaaaaacctagatcctcaaactgttctttgaactacctttgccatcttcctggtttcttcactaattaatacattgagtaaaatgtttaacctggtttcatttcaaatttgtgagtcacatttataatttttaaaaaactctgctttgacaaggggaagaatatcttttttaaataggaggagggctaggcacagtggctcacacccgtaatcccagcactttgggaggccgaggtgggaagatcacttgagctcaagagttcgaggccagcctgagcaacccagtgagacctcatctctaccaaaaattaaaaaaaagaaaaagatagccaggtgtggtggcactcacctgtagtcccagctacttgggcggctaaggcaggaggatcacttgagcccgcaagatggaggctgcaataagctatgattgtgccactgtactccagcctatgcaacagagcaagactctgtctcaattaaaaacaaaaacaaaaggatggcagtgttcttgtgactggcagtgaggtaacagatttcagtaaggagccttccctggaagcagacatgagatcttaaggacctcagaattaactaagaacctctaagaatgacacctaagcttctgcctaccaactatgttattgaaaagatacaaaatagtacaattttaattaaagacaaaataaattttgtttcgaattttatcaagtaatttcaagacactccttgataactggagacactcttactaattcaaatactagggtttaaacatgctataccttgcattccacaaataaatatgtgaatggtcctttaccccaatgacttatcctctttatataaatacacacacatattattaagacctctccagtgcacagatgaatagactaaaattcatatcaaaccataccaatagtcagttgttcaaaccttccatcagaacagctttgatcagaaatgcatgcctaatcctagtattttaataaacaacagtgcagtgagtcacagataaccctacagaagcacaagaattaaactggataaatttccctttcctggcatgttttctagtatatcttaaaatagacaaaacaaagcaatattaaaatcattaacatttaattcaattttgagttgcagctactgtagtaaaccagtaataagatcatacaagtcaacatcaacacatgtgtactgaaattttaggtagcctagaaaagtaaactatatgataaaaacaaaatcttcatttgcagaagaaaacctttcagaaaatatagtgcaagcttttaccatatttcccacctcccctcaagcttggctaagtaagcccctgcaagtgcttcccctataagctccatgttttataatgatttctggactcatctcctcgggttggaccataagcatcttgaggacagaaactgtaacattttcacttttcaatctccagccactagactaacacaatggagacatggcaagaaatgtttgagggactaattagttaaattccataaagaatgtgtatgtatcaccaggtaactaatctgcatgtccacatcaagaactctgagaagtcacagaggtaccacttgagtgataggcactcggtcccttagggaaagattgtgaaagatattgagggaccagtggtcaggttcgtaagataaaggtttccctccaactcctggggaaggtgcaatagtatagaaaatagagaattagccctgataaaagagaaatccttaaaaaagtattacttattctgtgatagagcactgaggaaagaggaacaaaagctccaatatgaaacaaagtgatcccatctaatcataaataaaagaaaaactacaagtgtttggtttgctcaggaaacaaaagcaaaacacctttcctcaggtggcagggtgacataattggagagtcactgaatactgtacatattctcaaattctcagctgggacactattttcagtctatctcaaactctctcaaaactgaagcaggtgctaacaaagactatttcttcacagtggactttgggttgggtgcaagatgccaaaatagacaatgtaaaatgacatgctcagcaccttgggcctctggcaattcttagcaccagggctacttctaattcttgtgaaagttctatcatacactactccctgagacctatactagcctgaagagaagggaatgaaagaagtctcaaatgttcaatagtgacttactcttgccctacctgtaggcaccccagggatatgagttccttcctctgaaatctgtatttcctgtgactaaattctcagtacaagcttcttagactactagtaattatttggcatgttttatgccttttaataatggctcttagttttctataaggaatggtggtattgctttttctgattataaacataaccattaagaaatgtcattccgtggtttcttaatcaatcattccctgtagtgtgtgagtataggactgggggctcagagggaagcagggagaagtgaagtgctaaagtgctacctccagagccactgacagttctgcccaatgcaatcaggcaaaacaagaaaaataaaataaaaggattcatattgggaaggaagaaggaaaaccatctttacttgcaaggttaaaagctttatacataattacacctcaataaagttgacttttaaaaagccacaaaaagataatgtacttaaattaaaataaaatacagaaactctaggataaagataatatcaagttattaatgcaagtttaaacattaaaaaatagttgctacccactcatcacagacatgagcagcaagctcattaaagattactgtgagcattcattggaataatggaagactcaaggttccaaaggcactgagaccctatatcaacaatgcttcacccttgaaacccagggactgatgatgatacagttgccatgagctacattctgagtaaatactttatcaattattagaacggttcaagtaaaagtaatgaatgacttaagacatctttctgaaatgactcttttatctggatgcctctgctattagggtgcaaggcaaacaaccttctactgtttgtttcattcatgatataaattgctttggcatattccctccaacctcctgaacctcaggtcgatctgtttgtccatttgtctgtttacacttcttttcttccctccttcctacgttcctctccctctcttgtggaagtgtatcagtaattataagagggtgctttatttcagaagacacaattcctgtacctccaatcactgttaccaagcaaaagagttcactgttcaatgtgttagaagccaatactatggcactgggtttttgagaaaagaaagacttttttctaggtcaaccaacaaggagacaggagtctagctcaaatctgtcttcctgtactgtttttaaggcagtatttttattagaaaatgtgtagggagtgaatttggggatagtaggagattggtagaaggaaaggggggtctgaaaaggctttgggcatttgcagtatctcttcatgctatctcatgggtcacatatgtaaattcagggggagttagtacgaaacatgcagtggaaatttgggctgtggcgtcagcaagctcattctgtgtagactctagtttgctgtattggttccaactgatttcagccagttttgttatcttaaaagcagagagaatttcagtgtttcagaaagttgtttttgttttttatttttatgaaccaatcctataaattcaagaatttctctttgccactggttaactctttggggcacagtttcattagtagaccttggcctccatactccaaagaactacttatctactgggtgcagctgaaccatttccataactgagatcatgtaagtcaggaatgtatacacattacacatgtgtgcagacaaaagttcatgacttcacctaccaggtccaagacgagtctccttaggaatgcctgcatacaagcctggcccttggctggtgtctgggaacttggctggtaaaatcattgcctacactaatataaattttttctaaatgagaaaagtagctcacttctcctaaaacatctgttttccttctaggtatctggaatttcagtgactgctatcagtcacactgacagtctgtgctcatgactaacccctgataaaaaccctaaactcttaagctcagacgagcttccctgatagacaacacttcacacaagtttccataccttgttattcagaaaattaagtgcatcctatgtgactccacaaggagaatattctggggagtttgtatctgatatcccttgttgattttgctttctaccttttcagtctaccatatcttagccatgaatgtgactacctgctgaaccccatgaatccttctatccaatcgttgaacctgggagagctctgacaaaggctagcatgggaaaatacgttgtcttcctcattaacagacccttcttagttatatctcactttctaagttcctgccttccacttcctaggagagaaaaaactacacagcattacctgaacatcatcccagggtaatcacagagcagccatctccgcaaaagaaggaaaaatgaactgtgtaatgttgcaatatttttaactgcaaataattttgcatacaaggcttacctacaattgaccatttttgcactaaatgcttttttaaagtaacaagctaatatcttcttaatataaaaatatacatgtccaacaaaatttaacttgttctgctatcatgaaaagaggaattccagacaaatgtctcataatgtgcagtcagtgggcttatataaataaggactaaaattacaagctcaataaaagatcatcaaaccagggaaaactccaagtaaaattataatacacagttgtccctcccacctgagactcacctgagactcatactttccttccaacatgcctgttctgcctattccctcaagactcagacttcaaatgagttccctttaagtagataagaacagtttcgcaacggattccagaaaaaccaatatgccacctaaaggacaaggaaggcatctacactaagaaaatgaaaagaagtcagagagagaacttcctgacttactcagattatatacccatgggtccacatatgcctaaaggccaaccttgtccttaatctttagtcactcaatctataaaataaaagatttagaaaagggctatgggcaatatggatcttttgcaggtacaaaattttttaagtccataaactttctctttaaaacactgaagaccattagtgatggttataatattcttgtctgaactgagagctatagtcaggctccttttagaagccctgccatgaacagagaaaaaagaaaaggcatgttcctactcctctatcctctgtagacatcttctccgtgataagttaataatgagaagagaaaaccaaccttctagctttctcatcatttaatggtttgaaccctgagtttctgcagcctggaaaaaaaaaaaaaaaagaggaagcagcagcagcagcagcagcaagttctcctcatctgaaattcttccctctcctagctcaccttccccaccttctcactcctttgtggtcctcacagtcagatatgaggtaataggtggaaaatacttccctgtgataaggcagtgatgcctgagccacccacttctggtaagaaagctgttcctaaagaatagcaaatggtactcatgttttgggggactctatgctacttagaagcgagtggctaaagttgcacggtgactaattcaagaacaaacagaagaaaaggacaaacagaaaaataaacagaaagaggcatgcccttagcctcaatcaggtagttctaagaaagtgattaggatggttcggagaccaccagccccataccttatccagtcaccaaacaacccaggctggggtgtggttgcctggcaaccacaccttccatgtaccgagtatgtcacaaatatgtctttccggtgtgtgatctcttgactgtgaaaagtaaaacgctaaatcaattcagcaggctttgagtgtctacaatgtgctagtcactgtatcagagatgtggatccagggatgatgcaataacttctgcctccaaggagctcatagtttagtggacatctggcaaagtactcactgattcttgacaattcatataatcatatcaatagatgcaaaaaagcatttgacaaaatccaaattccatccttgatttaaaaaaaaaaaattcttagaaaactaggactagaggcaaactttctcaacttgataaaaaatatctacaaaaaaaatctacagggagaatctagaggctttcccctaagataggtaacaaggcaaggatgttctcttttaccactcctattcaacatcttatacaacttctgactaattcagtaagaaaaggcatacagttgaaaaggaaaaaataaaactgccttgcttctcagatgacataaatgtctatataaaatatctcaaagaataaacaaaaacaattagccacttaatctataaaataaaagatttagaaaagggctatgggcaatatggatcttttgcaggtacaaaattttttaagtccataaactttctccttcaaacaccgaagacctggaacttagctgggcgtggtggctcacacctgtaatcccagcaccttgggaggctgaggcatgcggatcacttgaggtcaggagtttgagaccagcctgaccaagatggtgaagtgccatctctactaaaaatacaaaaaattagccaggcatggtgccgtgcacctgtaatctcagctactcgagaggctgaggcaggagattctcttgaacccgggaggcagtggttgcagtgacctgagatcgcgccactgcactccagcctgggcaacagagcgagactccatctcgaaataaatcaataaataaaaactcctggaacttaataagcaattacagcaaggttgcagaatacaaagttaatatgcaaaagtcaattccttttctataaaccagcaattaacaattggaattggaaatataaaacacagtatcatttacattagctgctccccaaaactgaaatatacaggtataaatataacaaaatatatacaggatctatatgagaaactctaccaaactttgacaaaggaaagcaaatatctaaacaaatggagagatatttcatgttcatgtatagaaacactcaatatttttaagacctcaattcttcccaatatggtttataaagccaatgtaattccaacaaaaataccagcaaattgtttcatgggtatcaacaaattcattctgaagtctatatgaaaacgcagaaaacccaaaataatcaacaaaatactaaagaagaacaaagttggaagacagataatacaagatttcaagacaagaccacaaggtactgttgaaagaatagacaaatagatcaatggaacagaatacagtatccatataaatatatccacacaaatgtagtcaactgatctttagtaaagaagcaaagaaaattcagtgaagaaagaatattctttttcaaaaaatgataatggaacagaccttacacctttcacaaaaaaataactcaaaatgaatcacagacctaaatgtaaaacacaaaaactctcaaacttctagaagataactgtattggtgcccaagagctgctataacatggtaccacaaactaggtggcttaaaagaagggaaaacaaatctggaaattagaagccttaaatcaaggtgtcagcagggctgcactctatctgaaggctctaggggagtatacttccttgtctcttcctgtcttttggtggttgccagaaatccctggacagcacgattcaactgtctcacacaatttaaaccacaacagtcttctctccaatcccccaaaagtcatatccttactgtatgcaaaacacattcaccccatttcaacatctccaggacccttgacccattccagcatcaactctaagtcaaaattgcctctaaatatcaactgtaatgtcccaaatctcatctcctaaatcatctaaatcaagtatgtgtgagatcctgggtatggtccagcctggggcaaagtttctctcctatggacactgaaatccacaaaacaagttatctgcttccaaaatacaacaggcataggacagacagtcaccttccaaaagggagaaactggaaggaaaaagtgggtcacaggtctcaaacaagtccaaaacatggcagggaaattttcattaggtttccagggcctgagagggctgtctggatccatgagtcacacaggtaatcttttcagtgaatggttgttcagccacacccttggtcctgtttcgggagtatgtttcctggattggctgagaactttcaaacccatcaagtgctggttcctttgcttaacaattccttcctcaagttatctctttccttttgcatttcactataagcagcaaggaaaaaccatggccccatctttcacgctttacttagaaatctcctcagctcactgcctacaagttctgctttccacccacaggtaaaacacagttcacccaaatttctgccactctgtaataaggatcacttttcctccagtgtctgataatatattcaccacttcctttctaaggcctcacaagaagcacctttaaagttcacatttctagtaacattctgttcatgacaacatatgtattctctaagatgcaaagaatctatgatagatgctttttctaaaattcccctctctactgagccttcaccagaatcacctttaatatctgtatttctacaaatagtcttttcaaagcagtctaggctttttatgttatgcacctaaaaattattccagtctatacacaattccaaagccacttacatgttttttaggtagttattccaacagaaaaagatttccgggtatcaaaatatgtattcatttcctatggctgccataacaaagtgccacaaattggatggcttaaaaatgcagaaatgtattctctcacagttctgggggcagaagtctgagggtggcagcaaggccatgccctctgttaggccccagggaaggatgtttaattgtctcttcctaacttttggtggtttcagtaatccttgatgttccctggttatagacatcccactccaatttcagcctctgctgttacatgaatttctccctctgtgtccaaatttcccttgttttacagggacaccagtcattgcattaggacctcagcttaacttgtttaacatttgcaaagatcctatttctaagtaaggttggactcacaggtatctggggttaggacttcaaaatattctcttggggtataaaattcaaccacacaacaataataaaagagaaaatctatgtgaccttggttttggcaatgagattttaaatacaacaccaaaaggataatccaggaaacaaagttgataagctggactttattaaaattaaaaacttcttttctgcaaaatacactgttaagagactacaaagacaagctacagaccaggagaaaatgtttgagaaagcacatatctgacagaaaatttctaataaaaaataaacaaagaactcttaaagctcaacaatgagaaaacaaacaacctcatttaaaaattggcaaaataggcatgccactgcaaattccgtgaaacaggagaaaaactgtgagttcccaaagtgtaagagggagaaaaccgacctccaaacacacatccctgctgggaatctgaaaatccagatcacaggagaagaatttaaccttacctagagatggaagggatttagagagtcacacaaaatatgaaagtagaagtagcagcaggaagtgccttgtatgcactcccagtctccagctcgagcatagggacgccatccctgactatatctcactggggcccttgtggaagacaaccagcagaactgcggaagtgttgtggggtgaagaaagctcccagatgaaattggtagtggtttcgactgggcacacattttctggagtggagtccgaggaaggagcaggagctgctgcagatacaagcaagtacaggagtacaagaactgccaccaacagagcaggggcaaggtctgggcggggcattgcaggatatgcgggcttgccaactgcatgggagttgagtcaggcctcttgctactggctatccctgacttccctggcaaactatataatacagtagaggcggccaagatcccctatggaacataaccccattggccggagaaccaacccccagcccccacagtggcctcagcaagccccgcccaaggagcttgcctaaccctgctgcctaaccagacctgcctaaccctgctgccacctgacggcatttccctacctgccctggtagcctaacacaaaacatagaaactctggggagcttcatcccctgaaccctgcccccagcaccctctgctctggagggttgtctttaattgtctatggagcatatatatatatactctttccctatggtatataagccctgagtctggggagtaatggtgtgaacatctacctgtcttacacgaacacatttctgcccaagaacacatttctgtccataagtttcccctaaaaatcaccctctgccaataaactagatatgcctgcctcattctttgatttcttggctccttctgtatttggaggttattttgcatatatggccctttcaaggaatatctatctatataaagataaaacaataagctatcaagctataataagatatggagaaagcttaaatcaatgtttctaaagaaaagaagccaatttgaaaggctgcatactatataattccaactatatgacactaggaaaagcaaaacttttgagacagcaaaaagatcagtggtaagcaggggttcaggggttgagctagaataatgaacagaagaagcacagaagacttttagggcaatgaaactattttatatgatactataattgtggatacatgacattatacatttgtcaaaacccatagaaatgtacaatataactagtgaaccttaatgtaaactacagacttcagttaatactaatctatagatattggcttattaactatagcaaatgtaccaaacaaacacaacatattaataacagggaaaaccatggggctgagggggtatagggtaactttctgtactatctactcaattttttaataaatctaaaactgttctaaaagtagtctgtaaaataagatttttaagagcaaacagaacaagaattttaaaagataattgtctgaagcacaaataatgacaattatatggtgcactttataagatatgtagatgtaaaatgtatggcaatcataacacaaagtatgggtgggaaataatggaagcacactgttgtaaggtatatatattatactatatgtgaaatgatatattatttgaaggtagactgtgacaaacttatacagcctagagtaaccactaagaaaagaataaaaagaaggagaagaagcatggaggagaaaaagcagaagcaacataagggcagagtggagataaaatggagtaaaaaattgagtcattaaagaaagcctcatttaagccaaaagggtatgggaaaagaagggactagattaaagaacaggtaaggcaagtgcaaacctggcaagatgatagattaagatctaatcatatcaataattatattaaatgtaaatggtctggccatccaaattaaaagtcagggattgtctgactggattaaaaaagtgagatccaattatatactgtctacaaggaacccaccgtacatataaagacattgataaactaaaaaaatggaaaaaagataacccatgtaaacactaatcaaaagaaggtagaatggccatattaacatcgacaacatagactttaaaaaatgataaacatttccagaaatgaaaaggggcattacataatacataggaattctaaatgtgtgtgtatccaacaacatagcttccaaagtgataaaatgaaaactgaaatgaaaaaaacagaaaaatctacaacaatgttggagacaagtaggcagataataaggacacagaaaacctgaataacattatgaagcaatttggcctaacttttatagggcatcccagccaacaacaaaataagtattaaagtggacacggaacattcacaaggatagtccatattctgggcctaaaaacaaaccataaaacattaaactgaaatacaaaatatgtttttaaaaatggaattaaaatagaaatcaacagaaataaatctttaaaattctcaaatatttggaaattaaacaatatatttctaaataactcccaattcaaagaagtgacaaaggaaattatacaatattctgaattgaatgaaggtaaaaatacaacatcaaaattagtggatgcagctaaaacagtgctgatagagaaatttatagcattaaatatttatattgggaaataatagaggccttaaatgagtaatctaagttcttaccttaagaaattaaaaaagaaattaaatccaaggcaagcaaaaagagggaaataataaagaggaaaaaaaatcaatgaaatggaaaataaaaaaataacagagaaaaatcaatgaaacccaaaacaggtccatgaaaagattttaaaaaaaattgctaacctctagaccctcaatgtccagtagaactttgtataatgatgaaaacattctatatagcagcaccctccaatgtggaagccacttgggactactgatcacttaaaatgtggccagtgtgactgaggaactcaatttttaatgtaattttattgaaattaatttacatttaaatagacacatgtgactagggataactattgaacagtgcagctctagaattgactactgaaagaaaggaaggggtgggaaggaaagaggaagaggaagagataaaggagggagagaaagagggaggcagagaagatgagatacacaaataaccaaaatcggaaatgaaatgaaaaagaggacttcactacagatcctaatgttagtgccattaaaaggataataagaaagtattacaaacaactgtatgccaaagttgataacatagatgaaaaaaactaattccttgaaagacacaaagtactaaagttcactcaaaaagaactgagtagcatatacaatctgaatagccatatatagttttaaaaacttgagtccatggtataaaactaacacaaggaaactctaggcccagatacctccctgttgacctctaccaaacctttaaggacgaataacaatcctatacaaaatgttccagaaaatagaaaagagaacactccaaactaatttatgagaccaccattaaccttgataccaaaatcaagaatattacagaccaatatctttatacaccaatatccctcatgaatgtatatgcaaaaaaaaccttaacaaaatattatcaagtagaatagatttatttctccatttatttggttttctctcttcaatgttttagagtttttagtattcaaatattacagaacatcattagatttatccctcagtttttcatgtttttgataccattgtaaactgtatttctaagttttaatttccaattgttcattgccagtgctaaatacaattgatttttgtatattggcctcacatcctgtgtctttgccaaagtcatgttatttctagttgcttttttgtagattcctcgggctcctacataaacaatcatgttgtctgcaaataaagacaattttatttcttccttttttatctgtgtacatttatatcttttccttcctttatttcactgactaggacctccctataacgaacagaaattgtgaatggaacatccaatgtgatgctggtataagaatagacatatacctcagcaggaaagaacagagagattagaaataattcacacatagcaacaattgatttaggaggggaaaggtgccaagataatataatggggataggatagtgctttcaacaagtgtgtgggaaaatgagacatccacatacagaattatgaacttcaccccatactcatattatgtacaaaaatccactcaaaatagatgacagacctaaatgcaaactctaaacctataaaacttctagcttaaagcttaggggaaagcttttgtgacactggattacacaaagatttcttaagacactaagcacaaaccacaaaagaaataattgataacttgactttgaaaaaatcaaaagcttctgctcttcagaagacagcattaagaaaatgcaaagtcaagtcccagtctgggagaagatatttgcaaaacacacatctgaggaaggacctatatcctaaatatatagacccttataactcaaaaagaggacgacccaattttaaatagtcaaaagatgtgaacagatacttcaccaaagaagaaacatagatggcaaataaatatatgaaaacatgattaagacaactggtcaacataaaaatgcaaaggaaaaccatacgaaatactgctacatacctactagaaatgctaaaatcaagcacacacacacagtccaatacaaagtgattctggtgaggatgtggagcaaatggaatctcatgcattgctgctgggatctctactcatcatcttgctttatttttcccaaaaccactttttattaccttaaagtttgcttacccatgtaagtccatatatatcttctcacatgtttattgtctatcttccccaatataagtactatgaggctggcaacttggtctgtcctgtcatcactgtgtcattctggcaccaagaacagtgtctggcaatctttacatatttattaaaagtgaggaaggggtggaaagaaaagacactaagacatctataagtgaatatatgaaggcaaggaacccagtcacagccatctacagaggagcgttaagagaaaattaatttagaccaccaggaagctgcatgttgtaatgcatgattcccaatttcagctgcacattagaattagctggagagctttgcaaaatcccaattccaggccacaccagaccaacaaaatctgaatctctgagaatggaacaccagcactggtcatttttttttttttttttttttttttagacggagtcttgctctgttgccacgctggagtgcagtggtgccatcttggctcactacaacccccacctcccagattccagtgattctcctgcctcagcctcccaagtaactggaactacaggtgcatgccaccacgcccagctaatttttgtatttttagtagaaatggggcttcaccatgctggccaggatggtcttgatctcttgacttcgtgatccgcccgcctcagcctcccaaagtgctgggattacaggcgtaagccaccacacccagccaagcactggtaattttaaagttcccaggtgatcccagtgtgcactcaaagttgagaatcactgaaaaaatggaacctagaccttggaaatgtacacaactgagtgtgcaagctacttaacctcccttagcctcaaaattctcatctacaacatgggaaatatatgtacctcccagagttgctgaaatattgagattctatataaggctctcaggaaatgtaaattctcatccccaagggaaacttgatcaaatcttcatagcttagggtaagaaatgctaattctaccagcaattcacatttttcattgttagctgattattttattgaacatttacattgaggaaattcagaaatgctcatttttccactttcctggtggtaagatgctgcctgaagctatgtttaaattttcaagagtaaataaactatggcgggaaatctagctgactatgccagtgaatctcaaacctagctgtacattagaatcatctcagaaatttttttaaagaaacacacgtacgtccagaactcaccaggccaaattaaatcagaatccctggggtggctccagaatatcagtatttttttaaaaagctgatagaaaggtaattgtaaaacacagtcagggcttaaaagcactgatttgtactaacgatatgccatgctaactgcacatcacagtcacttggggagctcttaaaaaagttgattgattccagaaccctaccgagacttactgattcagaatctgtggaagtggagcctgtcattgtgcaaatcttcataaaactccccactggtgattctgatgcaaactcactgagaaccactactttgtatcatacatttactctacgtgttgtatatcagaaagatcatttaaaactttcagtggtctcaaatgccaagcctgccagttacttttaatcagtaactgacacaacacatcacagtaactccaatgactttacagatcttttcagaacacttttatgtccagcccactgacccacatcacctaccctatgctgtgccaaatactggctatgtagtccgttggtatttctaaccaaattcctctaaatgggctgctgatctgggaaaagcaacatggaatcacattactccccaagccttattcccctttgctaagtggtatgtaatgccaggattaatgaaatgaactctattggtcaaatgagtctgaatgaaatctgagttgttgtctgctcctggaagcaaactgttatctatttgtttccctcagagagataaactcagaggaaacaggagtgatccctgaggtgggaataatatagtgggctgcaattttaaaactctgcttagacaataacaggacacttggaatcttattttgatagatcaaaccaatcagtatatacagcaccatggtggtactaccaggcaggtgataatagtagcatttaaacaaccaggcactatattaggcatattaaatatattaactcatgtgattctcaactgcgatgataatagccctatcaggcaggtactattattatttccattttgtcaaaaaagaaacaaaggcacacagaagttagatgatttacccaaagtcccatagctactaagtggcagttttctgaaaccaggcaatctggctttggagtccaacatcttaagtactccactgcaatgcagatgagtgatggccaagcagtttaaaaaaaaagaaaaagttattgtctgcagtagaaactggaggtcagggtatgggtaccttgggcaaattacttaacctcttggagcctatttttgcatctgaaaaatcaggataataattgtacctgccttgtagagctgaggtgatgattaaacaagattaggcatgtgatgtgcttagaaaagtacttggcacttttaagagctttctgtcagccattattattatttgtattttaaaacagctcaagtggtcagggagaaatgaaaatctattaaactgaaaattttcctgccaatcttagatttgtagattctgtagattaccagtacatcagatccaatatgaaatgcagtcataaaagattttcacaaaaacttaaggactgtcactgtgacaaaccccagcccaaacagtccaggacaatggctctaaaaagcaaacatcttcaattatcaagctgtgtacatgtaaacacaacaggaaccagacttctgagtagctgcaaactgcagttctctgtgatgggagaacatgccccagaacagcctgtcaagtggtaattgccagccatcctcagtcacatatgtataaacagaaaagaaaaacaaaacgagggctcaaataaaaagcgttaacattcattaaacgcctgacactctattaaatgtttttcatgcattaccttctttaatcctcacaacacccttccaaagttgaacatgaaacaaccacactggtttatatcactttaaatgtaagactacacgtctcaaatgggccctgagcactgcctgggaatccaactctatttctctagtacgctcactttcaccctctctaggactctgtcacatatctctcctccaagttcccacacctttcctctcccccgctgccctccctctaagctgatggatgcctataccaatagactcttttcccaccacccactgtatctgcacctgttatctcagcttcccctctagttacaacagagtaagtgtccctgctcatttcaaaaccaactactcacctgcttagggtcttctcctttctcaggtattcaacaactaccctttacaatgttcccctctttcatctgcagcagtttttcctttctacgagtttaatcacattgccatataaacattctgctttcttctatcttgaaaaaaactctacccaaccttaaggcccctcttccccattaaagttgttcttgtcaaaatgattaaaatcctcctaattaccaaaggcatcttatacggtaacattcaacatggttgaccactacctccctcccttttttggcttcgcctcctcttctttgtgtacactattaaactagatgtcttcaccagtcccatatattttaaatactatgtacagtatatgatgccgattccaaaggttaactctagcccgacatcctccagaacttcagatttaaatttctaaaaagcacatttgatatctcaacccaaatatctactagataatttatgtgtgtatatttcaccatactaaaaaaaactaccaggtgactgataaatggagagaaggtgaataggtaatgtgaaaaatcaaatgtgctaaatattcatggcacctgtaggtggtaggtggtcagagtcctctgcaaaattcttcccagctatgcttatgtcttctattgggaaaaacctactgggcatctcaaacctaacacattcaaaacataagtactgattccacaacttccaaaaatgaaacctaccccatcctacagttttccttgagtcaaggctagcatatgagggccttggcatatgggggcattgcctatcgcgttcatagatattctgagcttctagaacagcatctggcacacaggaggcgttcaaaatagctgctgaatggattgatgaattcatgttctttctttctaggtccctcgacctccacccgcccttgagtcattgggaagttctgggctgtctcagcgcctgatgatggcttcttaccaatcataccacacggctgctcctcagggagttggtggcattcccctaccacagagccacagggttcctgtcccggtcccgtctcgcataggcgccccaacacgcgtcacagtgcagctggcatcacacggccagaatcacgtcctgccctctggctgcagcgacactacttcacagctcaggcccacccgggcagtctcccgggccagggccacaacccacgccttgtgacccctgcacgtcaacggcatcttccttcttcacgcccgccctcccacagcccggcgcagcggcctcccgcacgccccctgcccacctggcccccagccacctttcctcacctgggcctgcggggccgccccaactgtcccgctgcaaccccagcagcctcgccagttgggtccacgcctagcctgccggccttcgtcgctatccaatcccacctgcgcccgcgagcctgcgcactggagctttgccctgcgccgcggcactctgccctgcgccgcggccctctgcttgccaggccgggagagacagaacctgcctctaccggtcttccaaggcactgagagcccatcgccgcggacgccgctgtaaattccctgcgggccctgtgcaccaccctgtgcgcgtccccctctcccaggccaggctgataatgttaacagctctctgagctatgctcatatcctgaaccactgaggactgtgttctccaggaatgctcgcctgacccacgcctgccctctaagcccctaatgaggccccagagggctggggtgggggggtctctttgtagtatcagagcagggcagataggcaaaaggagtcagagcctgtgccagaatatgaggtcagttggctgctaggtcaattaagacaacttcagcaagggtggtcaatgtagagggaattcaatcgttggcattgcctgaaaacaggaagccagaatctttttatcttgacgaacaaacctctattcattggtcctgacctgagccactttggtgaatccagataccctgaaggtgtgacaagacctgcctcacttatcccccagccttcagtgctggtcccacagagagccatatgcttgagctgaactgcagttaagcagtgacagctaccctctgtccaggctctgaggccagctttctgctccgtgagtcactgacagtgagtctctacagagactttttctttctgtagcagccaaggtaccctgcaagcaacccacgccattgccatatgtcttagtttgtttgtgttgctataaagcaatacctgaggctgggtaatttataaagaaaagaggtttgttagtttcacagtttcacaggctgtaaaagaaacatggcaccaccacccgcttttgatgagggcctcaggaagcttccactcatggcagaagacaaaggagagccaatgtgtgcaagacagaggaagagagagaggtgggaggtgccaggctcttttccatgaccagttctcatgaaaacaaagactaagaactcactcagttccatgagactagcaccaagtcattcataaaggatctacccacatgacccagacacttcccaccaggccccacctccaacattggggatcaaatttcaacactagattttatttatttatttatttattttgagatggagtctcgctctgtcgcccaggctggagtgcagtggcgtgatctcagctcactgtaatctccacctccccagttcaagtgattctcctgcctcagcctccccagtagctgggactacaggagcatgccaccatgcctggctaatttttgtatttttagtagagacgaggtttcactgtgttggccaggctggtcttgaacacctgacctcaggtgatccgcccgcctcagcctcccaaagtgctgggattacaggcatgagccaacgcacccagcccaacattagatttagatgggacaaatatccaaactatatcaccagggtaagattcccctttaaagatggaccccatgtctaatgtttcttcatagtgcctaacatcaagattctgcactggtcatcatttcacaaacatgagcagcatggctgctccaagacacacagagggaataacccccattcacatcaccaggaaatccttgcatggaggctaaatgaacagttggtaagagtggaccctgaggtgtcattccatctcccccagacttcctgcttgaccacacaatattcccagaagccagtgacccagaaggctcttcttggctttctgtccttttacctgtgaaaaattcgaagaactataaagtttagggcccatcacagtttactacccttctttggaggcctctttaaacccttgagtcttaccaattaccagtagcactaggagctttgcaagcctggccttaagtccctgctttgctactgaatagttggtgacctttggcaggttacttcccaacttgtgtctcagttttcctttttttaaaaaaggagacacagttgcaagtgtttaatgacacaaaaaacagaagcattcatcaccacgcctggcagtgaacactgcttttcttgctcaagaggtttgagccatacgcttctctaggtctgtgactctcccagagtttctgggagttcctctgtgagcaacagacccactgcagtctccatactttaggggtaagcctggatgcccttcacacatcagtctggatgagttcatgcaccactcatccaaaagtgaatccaaaagtgattccaaaagcagaggccagagatctagttgctaatgttgcctctcctcatggttctaggattcagccacacagggcttcccattgcagcttcaggtcctcctcactccccagtgcaggcccagtttcactctcaggtcctccagcccaggcctcagttctgcctcttttagtccatccctccagatccactttccaacagggctgggaagtcgcttggttgtcccctgcctgctgcaccacagcccccagacaccgcctccttatttcctgcatggtccgaggctcaatgctaatccctgggtgtcttagtctgttttgtgctgctataacagaattcctgagcctggataatttgtaaagaacaaaacatttttttctcacagttctggagaatgggaagtccaagatcaggtgccagcatctggtgtgagtcttcttgctgcatcctccagaggagaggaacattgtgtcctcatgtggcagaaggcagagagcaaataggaaaaaggaaggcaaactcaccctcttctaatagcattaatctcacccagaaggacagagtcctcatggtcctttcacctcccgaaggtcccacctcctaacactgccacagcagcaaccaaatttctttgaatattaatacatgagtgtgggaggggacaaacattcaaatcatcacactgggaaggctcagctggaggagcagaattggccagcacagggaggtaatgctgggtttggaatttttgtctttgcagtccttggccttgatccggatacccagacgccctctgagatggaccttgagggccgtgccaatgtctgctctctgctgaggtagggctcatctactccttacaagtataagaacttactgccaaacataccctcctccaagccatgggtccccagatacagtcaggaggaccccagtggatagctggaactcaggacctcaggagagatcccaaggcctatgctcgagttcagagttttctaattcaggcttggagcccaggaacagaagataattaagaacaatactgacagaaaaaaataatcacttcattgacattacccttcacaggaccgcctgcttcaggcctgtgctttgcagcctggttcatttgggaatggtatgcttcacacccagccctgttaagtgtgagttgatgaggaccatgagcttggaagaagccgtgggggcctctctgtgtgtttctctctgccctgctttgagacacttcacataaaagactctataaaaataaactgtggagatttcaatgccagtaaaaatcccagtggaggtagaaaactatttaaagagcacaaggacatacatttatcttgttgtgaatccccggctgcctggtccctgagcctgacacacggcagatgcccaataaatattaatagattgatcaatttgttggctgctcatccatttgcagcttcagccagcccatggctctgcgtgcacacaccacaaggagagagaatccatagacttcgacaggagagagctgctcagctggcaggagagcctgccacaaacccttgaacataaatgtcctgccctccacttccagctctacgtactaactgtaaaataatgatgtggcagaaagtgaagtgcaaagactgccaaattctaagaaagaacctggtttcatgccttttaatccttatgagtcattccttggtctgcgccaagccctgtgctttacagcaagaatacagatgtcttcattgaactgcatctcattagctggacctaacagagtgcaaatttctttccaatgccatttgaactcaatgcccagatgcttttttcccctgggcccgtgcagatgaaatcttgggctggtttataactttgaacacccagaatattcccatttcagtttaagattccctctgacttatctaattgttaggctctcttcaccttcagcctgagaaatgggtaccatcaatttctcctttctcacccagcttcacacccaggccctccagactcagtgggtgtctgacacctctacagctggagtccttcagcaatgggccccctgggctcagcagatattttgagctggccatttcttctgtgagacaatcttgtgttttctcaggaattcccctgcagaagatctctgagtacaaacccatgcccagtgatgttgcctctgcccagctacttacaagaccattcctcggcccatccagggctaccaatctgtttatgtaatttgtgccatgaataaaggtaccagacaaatgagtaagtggaggctgagttgtaggcatggttttgtgccccaataatgggctgcacaggaaaggaagggccacctttgtgtaattcataagctacaggtggatgcctttttgtgattccccctaatgcatgctctgtgtgagctgaggctctggctctctctctgctggggtcaacatcacccctgcttgttttacaggctatgacctgcctgcagcttacttgcctacataaaaagggcatccgcgcccttgccctgacacagggattggcggttcactcctagcgccatcctctttctctttgctctcccgccagacatgttgttgccgtcatcacctctcaccatgagattgctcagggatgttccagacaccaagccctttcagaagacacatgtcaaaccctgtatatgatttgagcagtctttctcatgtggctggagggaaaggagaggtacctcattcctctcccctccacaaggaggggaaagaggtatggaaggggaaatgtcatagcattccaacaactcttttcagaggaattttctactcctggcctcaattttttataaaccctcatgggtgtgttagtggtggaagttatctaggttatcggtggcaaacctgtatgggtctgcagcaatctcaactcttgcctcctcagaagaaagaatctgaggtgcataaggcagaaggagaggccaagacaagtgttagagcaggagtgaaagttcattaaaaggctttagagcaggaacaaaaggaaagaaagtacacttggaagaggcccaggtgggcaacttgaaggacaagtgccccatttgaccttgaacctaggatttcatatgctgaccgacttccagcattttgcaccccatttcccttgatttttctctcagggtgagctacccacatgcacagtggcctactagcacctgggaggtgagcatgggcagtgtgtttagtggagctgtacgcatgttcacctgaggctttcttccctttcctggtggaatgcctctggaaggtcatactctgccattttgcccgttaatgtgcatgcttgagcccacttgcccaattcctgaaagctgccagttacagatgtttttatctattgggaagctgcctctctctggtgctggctgtgaccaattattctttcagagaggcaatgtgacaattgcctgaccatcacctgttggttgcctgacatttcttgttggtgggggtagccctctcctgctctgctcctgcctgactagctacctaccaggaactccaaatgactgcaagagagagtttggagatggtccaagagctgggattggaattggagaactaggttatagccagatactggagagtttcacatgccatgctaagaaatttgaactttatcccataggattgcaggtgaacgatattcagcaggagagtacctggtcttatttgcctctgagcatgctgggtggagaggcatgatgaaagtggagacctctttggtgtgcactaagtaggttaataagcaatgttcagagaatcttccattcaaagtaaaaaaatttctcacctttttttctcatttctcaaggtggtttctaattcggtcttgagagccagacattcttcctggtttgggttttgtattcttttatgagttcatcaatcaggtgaggccacaaggggagacttagtgctcaggaacacaaaatctattatactcttgggtcctagagacagcaggcacagcaggccacacaggaccacatggggaagacaccagggtggccaggagactgaggacaggagcatgcatttgatatacaaactaaccagcacagagctacatctctatctggccctacgctccagagaccatattcctctccttaatcatcccagggccaggtacaagacaactagaaaccgtgcctagagccaaagcccgctggaatgattcaaactagctagtcctaagctgttcaccctgccttgccttgcctttcccatggaaacccggtaaaagctatggcctaggtggccccctcacctgtcttctgcctcctgaccaccctgatgtctttcccatgtggagtggcatggaatgcctcctgtttctaggacctgtgtgtatcataaactttattttcctgagcctgtcctgggtctcttcttgtggccacacctgactgaccacatcataaaagaatacaaaacagcttgccaggtccttaggtgggcagcatgattgagtgagaagggcataggcctgggttttatttcagtgcctttatctacttgtggcctcagacaaattattgaacttctctgggtctcaatttcctcatctataaaaatgacccttgcagtgtacgagtcagaataaactagattatgctgctgtaatagataaaccctgaatcttagccacctgtatcagtaaaggtttccttcttgctctcagtgcatatgcagtgagggtcagctggccactctgctccctgctccctgacttagcacacaggctgatggcacgcccactgtctgtgatcacattaggatcttggtgacagatggaaggagcactctggtgggtcgtccacctgcaattaaatacaccggcatggaattggcaatccatgcctctcctcacagctccgtggttggaaatcacatggccctgctccaccacaaaggggccctgtgtgactaccacagatgcctactccacaggtgtagggtgagggttacatgggctacaacacaaagagcctggtgcagggcttgaaggctggcaggttctgacaaaactcttctaggaagagcagcctccacccacagctgtggtcaagactaccagattcgcactggcaagtactttagaaaaagcatactgtctacagtaacactgctaagcatggagacttatttatttatttttgagacagagttttgctcttgttgctcaggctggagtgcaatggtgtgatctcagctcactgcaacctctgcctcccgggttcaagcgattctcccgcctcagcctcccgagtagctggaattacaggtgcccaccatcatgtctggcttaatttttgtatttttagtagagatggggtttcaccatgttggccaggctgctctcgaactcctgacctcaggtgatccacccaccttggcctcccaaagtgctgggattgcaggcatgagccaccatgcctggccagagcttttcactttaaaattatttcaaaatggtaaaaggaaatctgaaaagtccagtgaaggaaaaccacttgggaaacagaaatcccaaagatcaggattgataaatgtctctatcttcgagttatagacagagagggctccaaggacaaaatttgaggaaagatggttgataatctcttgtgtaagaaagttttcatttgcaagaaacaggcagagcaacttaagctggcttaagcatgcatagactgattgccacaggagctccaagtcccgctgcatgacagggttcagttggttgattcagttataacaactgggaccccagctctcaccattcttcctgctctggcatccagagtgttgatttcgcttggcttcctttgaagacagatcccttttaaggtcatggaaaggctgtcagaagctatacagtggggtagataaataattgcttctggaaattttccctaaagatgtgtgggcacttttctaaaagtccctatgaaatatttgtgtgtttcactggcttaaatttaactatgacttctgtccctagcaagaagggttgccttaaagccaattgggccttcccttctcccccacctctccttaacttcttgtaaccactaatccattctccatttccataattttgtcattttaagaatgttctataaattgaatcatacttgtactacctttggggattggcattttctcattccacataactctctggagtttcatagaagttgttgtgagtatcaatagttatttcttttgatatggattaccacatgttacttagccattcacttatttgaaggatatctgggttctttctcatttggggtcattacaagttaagttgctatgaatattttcgtaaaggtttttgtataaacacaaatcttaatttctctaggataaatacccaaggtgcaattgctgggtcttatggtgatcgtgtgtttagtttcgtaagacccaatcaaaccattttccacaatgtatacactattttacattcccatgagcaatgtatgagcaatcccctttctccatgtcctcagcagcattaggtgttgtccttattttttatttgaccatcctgatacatatgtggagatatcttattgtagtttagtttgcatttccccagtggctaattgaagttgagcatcttttcatgtgcttatttgccatctgtatattatcttcagtgaaatatccattcatgtatttttcttattttctaatgggatttttttcttttgtcaaggttgagttttgtgagttctttatgtattctaaatactagtcctttgttccggatacttcctcctcatttgttgcttggatcttttatcctcttaacagagactttttacagagaaaaagaataaacaaaaaacaatttgtcaagttttccttttctttttacagatcatgcttttggtgtcaagtctgagaactctttgcctagccttagatcccaatgattttcttcccctttttttccctaaaaatcatatagttttgcattgacatgtaagtccaggatccatatggagttcatttttgtacaaggtgtgaggtttaatgtcaatgatctttttttttttttttcatctacggatgtcctattgttccagcaccatttattgaaaaagcaattctttcctcattgaatttctcctgcattttgtcaaatatcagttgggaatatttgtgtgggtctatttctggattatctattctgttccattgatctatgtgtccatctttctgtctcactattactgtagctatatagtaagccttaatattaattacagtgattcctcccactccactctactttttgaagattatagctattctagtgcttgtgcattttcaaataagtttcagaagatatttttatttgtataatgtaaattacattatgaatatacaataaaatttataaaattaatttcagaacaaactcatctatgattacaaaataccttgctaggattttggtaagaattgcattggacctataaaattaatttggggagaattgatgcttttactatgttgagtttggaagcccacttttgcactacaatttagtgctgaatatgtatatgctttagcaacctcataacaacggtgtgctggcacataataggagcttcataaatatttatggcagggaggaaggatgggaaggccaagtgaagtcttgaagagtttggatcagttgtccttaaatctggccacagaaacaaccatctgctgagcttggtaaaagtacagatttctgggcttcatctcagccctactgattcagaatctccgggatgaggccagtgaatctgtattttgaacacctgctatagttgatcctcaagcacagccaggtttgtagcatgtagcagccaacaatggaagcagtgtgcaggcgctgagctgagtctcctaggaattagctgttctttctgacatttgccctgaaacaaagcaagtggtagctgcaattgagtccacctaagacaaattaacatgttcttcctgatatatggctcaaaatgagtatagcagcctgggagtcaagggtggtcctttcctacaaggaggaggaccagatgtattttgagcctgtatccaccaatttcttttccaaagaggaaataagcaaccaatgttcagcagaatgtgagcagttcctaaattgtaaatactgttatttaatcacttcattgcatacttgattagttccctaaccttgaggcctgtgaaactgtaatgatgcaccaggggagctggcctcagctctgagagaatttagaacaaggctgttcagatccctggaaacatctttttcattaatagcagaagaagccaaatgacccataagatttttctgtcataaggagaacagaaaaattagaaacaaaagcacatagaggagagttcatgaattagattttagagcacagacttttttaatcttagtctttgtttttgtttggttggttattgttgctttccttctcttattttgcagtttcagtctctttattttcaatgtaaaatttattatataagtaatagatatataaaggtaatttttaacaaaataaagtgtattctcctaatcccatcacccaaactttggtcaatttctgttccattgctgagcctcccctctgttcacggtgcttctccttgtgcctgcgaggcattccatagttgtaaccagcatgtaattctgagttattatatcaaacactttactaagttgcgagttcttcgtagttatattactttcttggcagtgcagtattctattatgctattgtaccatcattttctctaatgttatcattattctaatgcatttcagccaattccaatttgttgtttttatcaagagcactacagtgaacatttttaaataaattgatttttttcttattctggattatttctgtgggataattctcagggatttcattgttgggtcagtgggtatacccatttttatagcttttgatatttctgaatatgccagcttcagcaaaattttgccagcattggacagtttttttaaattttatgaatgtaatgaatgcaaatcagtatattgacattgttttggttagaatattttgtgtgtttgttggccatttgtattttatcgtatattttgtctatggaaatcctgtattgatctattataaattaaaatgggctttctaaatattaaaaatattaatctttgttcacaattatgtaaatgctttcccaacccattgctattctttttacatgagttttgtcattattattgtatggaagtttaaactttttcaatattgtcagctttgtaggttttctgttgttatacttttggtctactgcagtaagctggaagagtgatcattcctctgcagatctgataaaacgagagcctgtttcctaccagtctttctctgatgtgtgtgtgtgtgtgtgtgtgtgtgtgtgtgtgtgttttatgtgattctagtagatgaagtgggctttgaaactgaatcatttttccagctctcccagttgtatcaatgaagttgtctccccttcccctatgctgagaccccaactttgccctgctttctctgttacacagcaccagatatgctcctgggcctgcctgtggtcccccagtgtttcttttgtgcatttgctaatccatgtgtctttagttctttgtcctaatatggggtaatgctggatctaacacatcactctgctttctttactagatatccccatcttatttttccttcatatgctttgtagaatcaggtataaagtccaaaaggaaagtccttttaaaagaatgtatagctatgtggagttgtatagaaaagatacagaaagatatcaaaacatattacacccataaccttggagccaagccccttaacagagtccttccactgtgataaccataaaactcctttgttccaaggtgaactatgaagtgcaccctgcaacactgtatctgtcccggagagtgtgtgccagtgctgcagcaagacttcaccctgcctggggtatcttggaggaagagattggttctcaattcctttcacaaagggaagcccccacccccttctcaccacctccccttcccacacacacacacacacacacacacacacgcgcacaaagctttgctggacgtaaaccccagaactgaagagaggcaacagccatgattcaaaatgagtcttggaattgacaagcatgctcttcttgaagtgagctcttaacaactgggccaggcccttcatcccaggtcacctttgcaggagcctacaggtttctttcccagtggcagagctggtgggtacactctttggaccaaggtcacctgagggctcttctgtccaaaggacctccatgcagaaaccctcagtctctgcctcggaagacggctgttctctgtgtttatctaaaacaataagcagcttttaatgggtgacctcgtcattttgccagtagccttccctaaacagaacagttccgtcctcttcttaatcccactgagcaagggagttttccttagcctcataaaagagaaatattttgtgaaggaaaagtaggactcatgccactttatggaaagacctgtgttacacaaattcacatgaaagacacattctaggggaaatgtgaaaagccaccaaaagtagaagcagacagatgtagtgtgaatccacctgtcctacctgtatgagctcaggaaattaaatcttctaagcccccttaatttttttttttttttttttgagacagagtctcgctctttcacccaggccggagtgtagtggcactatcttggctcactgcaagctctgcctccttggttcatgccattctcctgcctcagcctcccaagtagctgggactacaggcacctaccaccacgcccagctactttttgtatttttagtagagatggggtttcaccatgttagccaggatggtctcgatctcctgacctcgtgatccaccctcctcagcctcccaaagtgctgggattacaggcgtgagccaccgcacccagccctaagccccctttaaaaacagaaataagaatatcactcaaaactgacataaggattaagttaaatcacatgtagaaactaccttaagacgcactatgactgtcttaatgtctaaaaggaccaaatgaaataattggtgattaggtttaaaggctacactgctctgtaggcaaagtcctctttataaatgagataatatatacagtggagggggttcagcttataggggttatagacactttggagaatttaaaggctgttaagacctgtatttcccaaaagaagcacacaagtcaacattctaggtgcaatagcccatagatgccatgaagaacacctgtgggctgctgcatggagccaaactaagaactcatgccttgggcactcatgttggcacacccatcctctgtctgcaggggagggtgagacctgttctcctttttgtgcaggatcagtgattctaacaggactcaccctgagcacagcccatgctacagtccatatatagatgagggcatggtagagcctggcacccttgccataggtgagtgcttctccccacccagacccataccacatgttagggcacaagtccaactgtctggtttctttgactacatggaaaaaacccaacaggattgaatgcattaaaaagcttatatcttctcactggagtaattctctcctttgtgattgatgataaaaatagctaatgttttttaagcgcttaccactacacacctggcgttgtcataaccgcatgaagtgggtttggttatctggcagtcagctgcatattgaatggtttaaaagtcatgtgctgcaggtctcccagccagtgagtggcagggccaggcttcaaatctgagctcccccaaccacaatgccacatcttctgcctttctcttcccggctggctcagacgcactgcagatctcagtggactggcccttgtggtccccaccaattgctcagccttcttctttctgtttcccagccctgcggagccagctccaagaagactgccccctgcatacaagctgcttcctgcttgcccacatttctgtgaatccataacgtacactcccaatgctgtaaagtgttgtacttccccataaatgaacatgcacagtcttcaaagcctctgaatcttccactctattaacttgttgcttcctatttcagataagaaccagcccttttgttatattttaatttcaaatatccactctccttatcagctggcccaccactgtcctctgaggctccagctcaatcatttgtggtggctgagcttccttatgtacagccaggaaaatggagctgggacacaataggaggaaagttaaggagtgggtttcaattatacttgaaacttctcaaactgttgtctcgttaagtttcagtggaccttgaaactgtgtttatgtgaaagtttttggaacattcagcatttttaaatatacactgtaagtactttaacagaatgttgagtggttacagacctgcccagaatttaacctcccttcctcccagtgtgacagtttctgttgcccttactttttctgtgtcctcatcaatatgttctgaccctgcctggtgaccaggtcagcttctggtggctccttgcattaacagtgagactttcctgatgctggtctatactcagccacagcagtccaacaagatgggccctatgacaggacaccaagactcttctctgcagtacatccagcagaggggcaggtaggagcaggcaaaacaggaatcagcactagacattcagacccccaaaagagagagacctgaggagagggatgcacactcctgtacataggaggcagaacagatgggtgctcgacaggtgggccgtggagtggggaaccgatcaggtttgaattctagttctgtcacttacttattggataaccttgggaaagccccaaatgtgtcatgtgtgaaatgggggtgatgacagtccccatgttgtaggtcgttgtcatggtgcaagggccatggtaagtgttctgtgaaaatggccattacaatgacgcatgacccccaaagaagatgcaggggaaactgggcaatgcccacagaccatcccccacccccagttgaagtggcttgatagcactgagccctgctctggtcagagctcagccccagttcacccagccagagtgacacccacctgagggcaccgtattccagggccacaggctcctccaggtcttcccattcactcccactctctggggactcttctggaggcaaagactctgggacagtgccccaagagcagaactgtggcaagggaatggtcccagaatctgcctccaaacattcttcacagggtagctggccttggcatgtagagttgatggtaagatactcttcatcctccgaggtgggagaaggggctccacatggatggtacatgtcaccttccccatcctccccatccaattcaggactagaatacagaagcccatgtttcttccagccttgataaaaaaaattcctcaccccaccttccccttgccttttagaatactctgcacgacacaggcccgtgagactcagccagtgttcaaacagctcatgccagaggctgctctgggcaccaggaagcaagaaacttataaggcaccaaccctggctttgaggagcccccaatttaatgagaagttggagcagtaaagaaatgttacagtccatgtaggaagtgctatggtagaggcagctggagcaccttaccgagctcaggagaccaggggggtgggggggcttgccagagggcacagcattgcaagcagggcaatgacccagttctaagacagactcgtcacatggcaagcagagtcggtcagactttggacaagtttattgacttctttggaacctcagttttctcatttgacaaaactagatggtcaagaagcatctaggattattgggacacgtaaattacataattctgacacagcccccccaactctgggttcctggtatggggtaagtttttagtaaatgtgagatgctgtgattagtactgtgaatatgatggctatttcaacagaagaattataaagaaagggcttcaggaagggattgggagtgactcaagcaggcaaccatcaaagcactttgtgcaaagatcaggtccttttctgagcactgaaaatttgcctatttagagatgcggcaagctgaagtgacatttactccccgcggaaggacacaggaggcagacaagtggtgaagctcattatctggtgatgcagccgcagacgtaatggtcaaagaacaagacttccaggggctgccccaagttcgccacacacgcctcttgattagaaagaatagtccatgcaaaggtagggcattttacacagcactgcagacatgcagagaaggtgctcagaaaatatctgtcgaaagtctggttagaggagatgagaaggaatatctaagagaaaagcacaaagatttagcaaatacatggatcctcatttctcagcctccttacccccacccaaatcaatgggttggctttgttatgtgctgctgctctccttctcctttcctgcattgcctctttctcttaaaattggctctggtgcaccccaatagctacaaacccttagatacccagagagcacgtcctcctccccagtagagccggaagcatctgtcccaaactgagcttcactgtgaaagagacattatttccactcatgagagctacaaggtatgtgaaatagtgaatttcatgtaaatatatgcacactcaagtgtataaaaaagaaattattctacaaagactgaagaggaacactcactgtcaaaagacatttttaattcttgagcatttgcagggaaaattgactttaagcttggctaaatcatgtagaaactgtgttttcttataaacatgggaaagaaacattcaagaagttttatcaaagaatgggaaatctagcctattgcccaggcctaggctcaccactgtccccaccacctcaagcagcacccccttccctcctttctgagctcactaagccttgttgaggagtggaagatggcagctgtatgtgtccattggccactgcagctgcctcagtgtccacacctcacctcccacccatagactccctccacctcttctaataagctccttgccctctggttttgattctgagctccagctactggctctgcctggacagagacctagagaagccatcagcctgagaggcaagaggcaaggcttcatctgaggttcaaccaaagaaaaagcgatttgctccccacttgtccagggggacttggtggtcccaagggtgaaatcgtggccatcatcccaccacaagttgggagaacgactgcctttccttctatccttttgcacgtgccatcaggctgcccttggagatttgacctggggctcaactgtggacatagggaaagggtgaatagggaataaagaggcaccagaagcctgtatgcctatttcacagaaagggcaagacttggaaatttggagaatttcattaagatagagacattctttcacagcaagcctcatgttttgcatgtggacatgatgggtaaagaggtggagttcttcacccagggttcaaggccggccagctcatggctaatgtagcaggactttcagcaagaccctgatgctgtcggagtacacggggctctctgctcaccccctgattctgtgtaatgatctcagcttcttcctgccctcactctctgcccaccaagctgtccaacagaaggaggcttttatagacagatgataactagaggagaatctggagatttcacttgggcttcctggccagccatgtctcccatacaaaccagcaggaccccagaaccagggtccccaccaagtcctgaaactcttcagtgggtatttttaagaggaatcccagttcagctctgaagtcagtgaaaccattctgaaggctctgcttgctacagaatgtttactgagaaaagacactgtgcccaacttttctggacagctgtcctttaaagacttgggccaccaaattcatctctgcctttcaggaggaaattcatagaagcagattgggcatttcaggcttgaaatatgaaggtattataattgtcctatttacttacggttaaactcacaacaaagtttggggtttgtgtcccttcatgtctccagttctccaacatcaggccccatactgatgtctccattagccctgatgacacagctgggagccccaggtctctgctcctgacaactgcatttagttttggcaggttggatttacagtatctctaagacatcaaagtaaacaagttcaacggactgccagatttgaagctcagatgataaatctgagctgaagtacaatacttaggatttgtcacagtagtgtggacagatacccctgggtatctggggatacccaaggatagccctgggagcctgtaaggtgtaaagagaatcctgctagaggcagcatccaggatctagcccaggctctgccgcctccctcactcccctcagccacactccaacccaagagcaggcatgacatctccctcacctggcaactgcatccctccctaactactctgacatcacacctggcctggcccctgcagttgagtgagatctctggcctcctaattatcttttgctattccaggcagtgcccttccccagaaggtatatcataactttaggttcatttccaggagtcctgcttcattttgctttcttaaataaatgaccatcaagatttataccatcactttcacaaagtgatgcttgtggaacttacgtgcattttacttacatgagtttaatgatatgtgctaggcaaaaagagaaagagaaagataaccttaaacattctgcaaagaccaactttccaaccgataagtgtaagccttgaagtgcacatgagtgggagaactaaatctttcatcctgtcaatctgtctctgtttctattgggccagcatttaaagacaaacattttgcatacagcatggcccataaatgcaagcctcctaacttcatctgaggctcgaccaaacaaaaagtgatttgctcccacaccaaggggcaaataacatcactccttccaaagtgatgtttcaagggtaatgagacttgatgtgattgttgccttctgcctacctttaggaactaaccttataaaaaacatgtctccagccaagctttccctctgataggcacgtaatccaactctccttcataaaaatgtactgtactgctttattacaagatatttttataaagatctactactagatggtaaaatctctagatatagagtgtgagaaaagagaacagggaaagaaagtgaaatcgaatcttgtccatgaacactttgggtttgctgtggtgctggcagccatctggctgtaggaaattgccacctggcagatggtaagttccggcaatttgctgggaatttcaattgaagggacctgttctttagctggaaatagctcaggaaagggaaggaaaacagacttgcattgagttcttaccgcatgccaggcactgtgacagcaccctgagcgtgctatttcttttgacctgcacagtaccctgtggaactgtcatggtccccatttacatttgggaagcctccagcttagggaaggcaacgctccaggcatactagtaagtggcaacgctgaaaccacataataggatacagaaatccatgctctttttgttgaagagtttaactcacagatgccagacacttaagaggcagtggcctgcgacagtcacctcagaactgagctgcaaacacttctaaggcttctgcagagtcacaatcccactttggaatcctgattcagaccctatccaggagctgggggaactgtgtccaggggtcgctgggcatgcgtccctcttttcttcctgtagggggcagccactatgtgtgcattaaatgcaaactgacgtcctattggaggagaggtggacttggtttgagttctttcagaggggaggaaaggttcctaagtgagggagggaaaacgaagtaaaaataaagccaggaaatgtgatgaggcagaaagcattcatcaacagaactaccacagggaggcaagagaaaaagggggtgcggttggccattgagagagccaggataccgagaacagtaaagctgcctgcccacagttcatccatgggtacatggaccatgtgggcccggcagtgagtatgatggttgatgggcgttcacaacagactgaagataggagactcccctggaatgctctggacaagcccttgggactctcgtgtggctctaaaaggagcagtccctccaagaatgacagattttggacatctggtatacccttgcaaatagggccactaagccaaatttaatttggttcagaaaaacagaataatgtgatgtttgatgaaaaaaaaaaaaaaaacagcaaatgctaacagataggcagaaataggtatccggacttggaagtagaagacataaagaggcataaagatgtggaagatgtgggagcaaatcactttttctttggttgagcttcagatgaagttaggaggcttgaatttatgagccatgctgtatgcaaaatgtgtaactttaaatgctggccctataagaacagcataacagcataaagatttcaccttaatgtaaggaagaaccttctgatcagtaactagatgatgataaaatgggtcattcaagaggtagcaagttccgcatccctgcagatattcaagcaaaagctgggaccccttcttcaggaatgttatggagcagattccagcatggagtttgaggctagactagatcatttttatattgaacaggctgattttctgtagtttaatgaatgaaacagtgactgcctatactaatagtttaaaataccattttaaataactattggctatattaaattaaaggcacttggcaagtcaaattcccagcttgtacctatacccagggtcactttataattcagctctcagggtccctgttcattatcccaagctatctggcagcaaaacctttcaatatccaaacaagtgcctcctccctacaggaaagtaccgttcctgtaatatatcctttaagatcatggtaatagttgtccttggacaagtctctgtaggttactttctttattattttatcaagtatgtcaattactgcctagactgcaattgtaaagaactataaatacacttatgttatacattatcagacaacgaaagtgaatatcattgatgaatgtgcttgttcaccctgttctactttgcaaaccagttagcttttgtttggctgacacagcattcttcaaaaaattgtagcagggtacttttagggaatgcatgcctggctcctgcttgtcacagctctcatcgggtccaacggtattacacgactgcttcacacttcacagagactatcatttcctatggatctacctttgacagtcgtctaggatggctaccaaatgagagccatttaatctcagtgggtttatagagtgtcaaacacaaacaattgccccttgttatttacctgctttgtgcccatgcctctggctggcaaatgctagaagcaggtcttaccctacatgtgcagccctctgtctgctctcaacaggtttccaagcaccttgtgtaataagtacttgtcaaactgaatcaaagactatgtgttccctcagcataggactgagaatcggaaatacttacagatggatggacacaaaaatgcagactaaatttaaaatgactgtgaaaatgaatgttgcagggtggtcttgaagatatagatgtgttcagaaaacaaaagctggtgtagccaggcatgatggctggtgcctgtagacccagctattgaccggctgaggtgggaggatcacttgagcccaggattttgaattcagcctgggcaacatagtaagaccccatctttaaaaaaaaaaaaaaaagctgatgttgataatgaagcattatactagcaatagaaacgaggatgcatgtaggaacttccttcttactacaaagctttaacaggccatggaagatacaagagaaaggtttgtgtgccaggagaaaacctgaggcctgccacctatagcttccaagacatattggggacaattgtggtctgggtagggtttgctttcccaaaagctcacaggtggtcacagcagcaccagaccttatgcttctcttgttgcaacctctcttctaaatgcctggaacagtgctgggcacaaaatcatccaagcatagttattgatggcttgattacaatttcctagcaatgagatgcacatagtttacaaaatgtctgcaaatgtggtgattcttaccttccaagtctcatgatatcacaaactgaatagcagttttgcctcacatccttttccaaagaggtcgccaatgttgattcatccctttcttggtgaagtttgcataaatgagggtgggactcaggagaatgtgtcaaggaactggcccaaggtctctctctgttttggccccattgtgcctctctgatggccttttgggaagactctggcctgagacccaggccttcccctgcatctggggaggcactgtccctccagctgtcctcttgatccaggatggggctggtacatgagtcagtacatgttgccctggtgaattctttgtcagctgagagttcaggtgtctattaaaagaaatgctactaattactggctgcgggatgcacattgtttttttaaaaatacaaagcttttttcccccatgtgattatagatcagagtagttacaagatgggctttgaggtctgtctatcaccatagcatcccagctcctccacatgctcccagctggacactgggcaacacactcaggcaccttagcttagggggctttggaagctctccataaatgtgagccttatttttaaataaaaaatatttgcaaaatttagacaaagataaaaatggaagataaatatgcaaaacaatgactctattccactttccgataagaaatgtttctttttaagtttttcatcttcatctgtcatctcagggcttgtctccctgtctccacccccatcaaggtgatgttctttcctgggtctcctcctcactttcccagacatgacttgcttcgtctcaactgctcacctccctgtcagccttttaggttctggttttgatgatgtgctatgtcttgctgccactgcttgaccttctacagaaaaacaatctgtgtttcagtagaaaactgtttttatctacagcagaacttgctgggttctctgattctggctgtctccactgtctttgagctattttacaactctataaataaacaggtcctttgaaatctcttttgagccagttttaacatctgcctggttccctcactgaatgagttaaataaaatctttaacgtgttcatttttatatctgtaggaatcatgattttaccttttcctgaaaattatcttccagcacttccaccccatgatctccatacctgatgtaatagagcccatgcctgggttcccacccctgccctcacctacaaaagaagaaccaccccaatgagtggtctccccacatttctgattgtacatccctaacaatgagagggatacacctccaaatgtgcacatttatttaattataaatcataaacatttactactcttctgatagactggacattataaaggatacaccaaaaatcaaaattttaagaagaccatattttgtcacattttcatactctttggagagacctccaaaatctgttttctaacctatcctctccttctagctcattatccctggacatgctctccagcaatccttccccactccaagacctccagtctgtggagctgctgcttttcatcattacccccactccccttccctgtcacacatgtcctcggtgtgcctcttattctgcttagattccatggctctgcccctagatgctcacttacagacaaggaagaccctgagctcccacctccttgcccctctcttcctccatcacgtgtcacttgcagattctgagtttccattttaattcctactcaaactgtgtgaacctcacccctgcttctgagcctctgactagattagcttcaagtgtgtgactgcagatgtcaaatgggcagtcaagacttccacataatctttgtctgtgtccttaatcaattcagttttctacctctgctctctaaattatttctcatcttgtctctctcttcaagtttctaacaactccaccctgaccttgcctgtgacctcacagtgagaatggacacgttcagatgagaactcttcatcttcccacagcaaattccactgagcagcctgtgcccctaccccaacttcagcttccacctctcaccacccatttctgtgctctacttcatggcagcctcttagatgagtgtctcttctcaccgtttccacgcctccctccttctttcttgcacccactagcaccagccttctgtccttaccacccaagggaaggagcccacatcagggtccccagcgacctctatctttctaaagctgaagaacaatattttgtcctttcactctctctctcagcaacgttcaacaaagtgtgtccctccctccttcctgagagcttccttgctcattagccctacttacatggagttgaccatgagccccacccttgcttggtttttccaccaattcccaggccccatcttaatctcatatgttgtcccatctctgtaccaggcctctcaatgttgttatgctctgtgctgacttctcagtcctctccttgaacttatctgcactctttcccaaggtgatctcaaccatttcatggctttacacgacctctatatatgctgacaactcccaaattcacttttcccagccccgatctcatgcctattctccacaactgcctaatagactcttcactggatagcctataaacatctcagttttaaatgataccaagaactattgtttctcttccatgcaccccagatggccttccccagcccctgtaagcagtccctctcttgggaactggtaccaagagagatgaagtggaaaataggatctatgattaccctcctaaagcatgaaataggtatatgtgatctagtgcaaagaagagaggtattggaatcaggaaaatcaggctttttaccttcttacccctccttcaccctgcattggtggtagcaccatttccccaaggcttcctcgtgccaaagcttgattgctctctttcctcatgcctgtttctaatcccaaagtagtctcctgaactccgcctcccagatgtatcccaaatctggctgcttcttaacacttcagctacagcctgagtccaagccacatcatgtttgacctgaatgactgctgcttgacctcctttagtccctgtgcaccagtaacccgagtggcccctctgaagaacggaggagggcatttcctgcttaaccctccatgccagcccagtggcttcccactgcatgcaggatggtggcatcatgctcctctgatccccaaggccctccagggtccctgccacctccacaacttcctccacttctgcttcattaacgatggcccaagcacacttgtatttttgtccctcaaacatccaagtgggttcccatctcagggcctttgttcatgctgttccttctgcctggaatgcccttaccccaaatgtgggcatggctgcctccttctcagaggtgctttactttatggactaaatgcttgctccccagagctgctgacccttgttctgcaatctgaccactggagccacccaagcaaatcacaatcctcccacttggccttcgggtatgaggagggaaagctcacccccacacctcacctggacccttcctgctagatctttatgggctctcctgggaggagctattctccaggatggaaataccacttttttccctgggatttcctagatatttcaacaaaaacacagggtcccagcaccttggcctgaatttgtgtgtgtgaaatttggccctctctcacctggttcggtttcttaacacaattgctgctgtctaccttcttttccaacccagcaacttttggatatctttcccatagctcttccctccctagaggctatgtcaaatgacctcttggagtctaagcatcaacaggatctgggacatcaagtcctttatgttgtcctagtgatggtgtcaccctcaggcacaataagtgatcacttttatccacatcctagagatgaggaatcatggggcctagagaggacaggcaactgcccaaggcccatgcagcacagcaggtacaggtgatccaggtacccgcccagatccccctccaggactgagattcgcatcctactgcctcatctcccctcccctggggcagcccacaccccagcgctggttagggcaacaagcaaaggcacaggttctcttgtcccaattcatggcagctccaaggggccatctctgctccagggctccctccagaatcagctgaggccctgtttatagctgcacattgatctctccttctgccccaccccacctcagtcaccctcacaggggatgttctcaagcgcaggccccataaaacctcccacgctcacatctctgctgcaaaatctgtttcctaggaaccccacagaaggcatggcaatgggtaattgtatctgtcaacttggctaggccatggtacacagataggcggtcacataccatctagatgtcactgtgaaggtatttttttttagatgtgatttgacatttaaatcagcaaactttgagtaaaacagattgtcttccataatgtagtgggcctcatgctgtcagctgaagcccttaagaggaaagactgacctctctgaggaggagggagttctgcctccagaccacctttgggcttgatctccatcaattattctctgggtctccagcctgctggcctcccctgtagaattggactggccagccctcaaaatcacatgaaccaattcctataataaatctctttctctcactctcttcatatataaacacacacataaacacacacacacacacacacactcattctatctgttctatttctctgagaacctgactaatatatgtgtcaaggtaaaaatccctattttcctgattccaatggctctcttctttgaaccagactgcacgtgcctatttcatgctttaggagggtaatcatatatcctattttccacatcatctctcagaatggaaattcttattggaaattcccttggtctgcttctgtgtctactctccttcttcccaggcttccctctctgatgcctgagcttccagagagcctggccctaaaagtttcacagccaaagtctaaacatgtaaacatctacaagaagacccaaatgtcagaagaggcagaatcagggagaggaaggagacctactgaggtttgggggccagctattttcctacccctgtgaaaggaggtggcactgaacctatctacaaccctcttaggaccctagagtctggaaaaggggggcccaaccagagccaggtagagagagtagaagacactgcagcctacctgccattcctgctccatctcaggcagcgcacctggagggggtcggcaaaggaggagcgtgacttcctgtggggcccctctcagtaaatgcagcacctcctgcgagaaaccaagattcactgttagatttgggcttgcattgctggggatgcagtgatgttctccccactgcgtcccaggcactagctcctcctccctgcaccttgatctatttctcactccagagaactccggagaaccctgctgtgggcctgacttttcaaagtgcaaggaaccaaggtcagtggcctgcagcttccacaaagttgatgcaagatgctgggctgtgcatcacctttgtgcagcttgggttctgggaacctctcatctgtaatattgcagtaacctcctctccgctccctgccttcaccagtgtcacccacctgcctccttccacattgctcaagggaatggcaatatctgccaataccaatgccttttcttcagagagagaaagaatgactccaacaaatagctgttcatctcaattgccctttcctcccaacctgccctcatcttgggccaccaattttgcagcctccaccatctgaatctctaaagcctgacccttggctctgagcttcctatcagggctcggcttgggctctgggaacctctcacctgtagtattgcagtgacctcctcactgcttgctgccttctccagtgtcacccacctgcctccctctgcaatgctcaagggtagttttccacagtgcagatataactgagtccttcccccactgcacaccctggctgactcacttttccctcaatgtaagctccaaggcatagcacatagaccccgtttctgcctgcctctgcctctcaccacagttccctctctcccatctactcccctctgcacccacgtcctaagcccctgccatgctgaatctgttgctccaagccaccctctcaatgtccagggttcaaggttgcctcgatagctcctatttcctatttagaccaggatttctcaaactcttggcactgttgacctctcaggctggacaattccttatgcgaatgcctgtcctgtgcattgtagggtgtttagcagcatctctgatctctactcactagatgccagaagcactcatcagttgtgacaatcacaaatgtctctggacttaatcaaatatcccatgagaaggaaataatctctgcttaagaactgctgatcaagacactccccagtccctgcttcagccacgcaggacttccaaggggtgcacttctttcctggctcactggtgtgagcactgcagcatgggctttcatctctcaggatacatatctcctgccatcaccgctgttttctgtccatgagctctgaaactgcatgagctgtcttcctctgtgtcttcagtctctcatagagttgccagcccagcagtggttctcagagaagggttcttggatcaggagatggatggatgaaggcatgccctcccacccaagcatatggtgttctagagacctccccccagccctgcccagagccactgtccccctttgtccatcttgctttgtgtttctggagctgacttataaaggctgcatgaggcttcctgttgggctcagctaggggaacacggcaagagaccagagacagggaggagcggaggtcattgctccttccaaattcctcccttcaggttgccatgggacgactacaacctcagccaaagtgagagctcatgccagcgagtcccctccaacagctctccattcctggggtggaataactgctctttcccttcccctttggcctcaggataggggtaactgcatcccactcttcctatcctagccctaggccacaacatgctcccttgagcttcctaacaacctgcccacacctttattaaatgttcctcaaatgactccattttcttccaggactctgtctaatatatacagtatttcattactctctcttcttaaattgcattttttatcatagacaggacaatcagtgtaataatgtatgaaaagctgtaaatgtgttgagaaatgggaaggagagcagaaagggacccactctagtcccttcagccccacgcccacctcccaggatgtgtgtgaagagacgtcagccagcacaaaggccagggctttatcttcagcttctctcatgaacccagtgagaagcaaggctgactcaaggtcagatatttaaaaacagagattttaaattaaatgtgagcatgtaccactaattactctctttgtgtgattaaaatccgggctgctggtgtgatttttgagagcccagagttttccccacggcagcaggctagtaagaggcaaagctggggccagcctgcacagagagctgcattgcccatgacccccggcacctggaagatgaggccttccgtggaccttccattcacggccaggataatgtcaccagctgcaatggccccattctcctcagctggctgccccggaaagagcctcttaatcctcacaagatcacttttgagatggctgcagctctctttctccatctgcacgaaactgaatcccaaaccattggcattcttttttagtttgacttcaaacttaggacctgtagtgtgggatgttgataaaaataaattcttcagtagattacaagtgaaattgaccagtctcaaaatgcagattgtcaagtagatgaattatttcttttacgttcaaataattcctttgctaattttatgacagagtacattatgtatgttatagattagtgctgtccaataaaatataatgtgagctataaatacaaaccacaaatgtcattttgaagttttcaaatagctacattaaaataaaaggaaaaagcaaacaaaaaataaataaaacaatttaaaaagtaaaaggaaacaggttaaatacgctataatcgtacatctaatttaatcccatatatctaaaatattaccacttcaacatgtcatcaatatgaaaaaattattaacgagatattttttattcttcttacgaactaagctttcaaaatccaatacatattttatccatttagattggtcacatttcaagtcctcaataaccacatgtggcaagtggctaccatattgaatagcacaattatagataactcaactatgtttatacataaagatatagctgctaggcatacacaacatgctcttggcatttaataaaacttgtatcacatacattcctattactcctttagaactctagtcatttgtagtatacttgaaactaaattttgaataattagaccatggagaaaattatggccaattctatggacaatgctttagctgccattttgtttacccatgtaggctgaccataagacaaaacagttgcctctgggcaccaaggatgaacagagctggcaacctacatggtctgtccaccaaagaggcctctgggctgccccgctggcatcaatgcacagagggacagagcacagcttgcaaacttcaccagggcaagaatggaagcatgtgaagcaattatgtgaagcaattatgtgaaggtgtgtcacacgaccagttctaccatcgccctaaggcctcctccactctttggagtccatttctcaaaggccccaagggagtgagcaaaggggtgaggacagaggagacttgatttaaacagaagcatgcccctttgccccacccctaccctatggctggcttgagtcttctgcagcaaaatcagaaaatctctatgaagggactaaaacatggctaaggtccaaatcgttcttactgaggaaatcagcgtgttcctggcaaataccaaaatcacaagggaattgcagatgggcagcccatcggaaaacgtgcagttttgtccctctaaatgatcgttcgtttgccttttaaaatgatgctaataacaaggctagattcctgaaccttctctcccaacctgcctagtcattcctcaaataactttgttacaaatgacttggctggactgtgaagccaaatgtatctgaaagtgtatgaccctttcagtcaatttcatcctaaatattcacacaaacattaacattctggcagctgatcaaaggactgaggaaggctgggggcagaaagatgcctagaaatcatttggggaaaatgcatttgtttccagaaacctattccatgagatgggcttccatggcatgaaaaagccgatctcagcatgatcaccatggctcgctttcttttcaggacccagaggaagccttcctgcctttcccttttgacttgacaattcaaaagcggcacacaataacatgacaatagtaacactcaattctctcccctctcaccatctgtcaccgagacacagctcgaaggcctgccaggcaaggctgttaccaaggaaacagccgtgcgttcatctcccatgctgtcattagcagaaggacactgctgtgtactcctggggactcttctctctaagaccagtcttgcaacctagaaggaaaggtgaacaaactcagtttacacttcatatggcaaccaggaggcactcccttgactctgcaaatgcttcttaattttcgaatccttcctataagcagactcatttgaatctctcaactagcctatatattgggatctagacccagatttctcagtgcttattagacaagtgcacctgaaagcaacacatgtacctccacttcacacatgcagtgccacactcatcttcctcccctcactcaccctcacttcccctcctcattcttcctaaaacactcctcccctcgcattggctcaccccaccattaacctgccaagggccacatttggagtggtccagctctcccccatctggtttctaagatgtgaacattccccatcaagaacagctcctcagtgccccctcccctccacctcctctctcactgccagtgacccgctgggccgtggcaagctctggttaccttggctcgctggaccctgtctgcaaccttcttggtccaccccatcatggctgccagtgaattggtctaagacaaaaactgaacatgcaacattcttgatttgaagtctccaatgcttcccatcacctaagacccaaacccatggcaccccaggtctgtaccacctgccctcccctttctttccaatgtgatttcccacatttctccccacaacaccatatacccttgtcgccctaagtgtgattcaagaaccagcagatagacatcacctggaagcttctcagaaatgccaagctcccattcagggcatgtggccctgccttcatcttcctgttgcacctgtcactcagcacctggcccaggatcccagagggacaattcctacctgcttaagctgccaggaggccagccaagtaccctctctacccatgctcattagcaaaggtctaaatatcagaaggtgccaataaattatggctctgttctcaagataggtcaaccaaagtcactaatataagcaaatttcaccagacaccagaaaaacgctttgggaaagaaagcgaaaagtggccagaacattgccccaagcttgctggaagggccttcaggaatccctcctgtctctgttgactttttagttgccaaaagagggtgatgccagctctgtggctcaggacacagaggcagttagaggctcctaacctcaggcagaggactcggcacagtgggataacatcgagtcactgcggggcagggaataaaggggacataaaggatgaatggctctgctcttggcaccctgaattcctacctcattgtgaggaaaagaatcccaggacactctgacccacgccccggtgggtacaacacagggtgagggggaatggcatgaacagggaatggagtggggtcatcccatgcaaacgtagggaggtaagaaggcccatggtcacagggccagcggggctggggcagccagagccaggctagagcagtctcttcactccatcttctccattccgctgtctgattccagaattcaggcaagccaccagtaagtttctaaggctatctatggggggtgagattttttttactcagaaacatctatctgctatctcctgggtttcacatccccatagaaaagtgagggtaagaagaaatggaagagaaaaaaaaaactaacaaagaaaaagtcttgtttcctgcctgcctccctcccacccagaggcgatttcagcttctgatgttgttcaggaaagttccggaaggaggggaagctggtcagcaacagtccactcacctgcccaggacccttcaggcactgcacagcctgcttgtgggtgaggccgcacagaatcactccatccacctgcaggagtcggtcacctgggaaagggatagatgtcatgtcatgacctggtgcttgaggctgcaggaggttcccttccaggaggaccctgcccggcacccctccatgcagcctggagaagtgggaaaggaagctgaggtgccaggtgtccccctggagtcagcaggaatcctgcctctctgagcagtctcactcccttcttctcaggcacatcacagatcagggatataaaagcctttctattattggctcacagaatggttgagccagctctgttcaaccttatccttcctcctgttttcctgtgaaaccgtttttgaaagtattttcaagtcacttagatatttatatctccaggatgtattttttttatttcaaaaaaaggtcagggaggcatggttgacgctggggacaccagaattctaggggaaatggagataagtaagatcctaggttccccttttggctcaattctggcagttttggagaccaataaaaatcacccccttccatcagagaagtgggagctgagcaagggcaaacagaaggctcaggtgtcctccccggatgtgcgagtgagtttaccgaggcccacttgtcctccaagggaagcagtatgttttcccatggaggccaaagagcaacacaagtcttttaagtcttctactatttttctatcacctatgcttcccagtgtgccactgcagaccccccaacctatcaaatgggcagggcagattctatcacctcctttccaggtgagaaaagtatgacctggggaggcaatcatttgcatgagttttcagaatgggagcagggcaaggcctagaggctgcccctcccagtgcagggctctttacaccatggagcacagagttcccaatgaggacccatccccatctctcaccctgtaggatctgcccttccttggcagctggtcttccaggaacaatggatttcacatagataccaccatatggcacactggtgttaatgccaccctgaaaaacacaacaaaaaactcaccacccatctttcctcctccaggaagcctccccaacctccccagctaagggaatccccacctgcccaccactctatcccatgaccttacctccgactggcactgtcttctgtattcacctgtttgtttagattgtattctccactgagcaataagattaggtgttcataagcttaacaatagcaactatgtgagagatctgggcatgtccccagcccaagcactggtacaaggcaggtgctcagcaactgctcacgtgggatgcaccactatctctatataggtagtgaccagcgtaggtggatatggctatgggcctgaaggcttgtgcctggcacgtcttgtgtgctttgatgggccaaaggatatgtgcatttttcattataatagatgttgccagattgcatccctatgtgaatatggatatacttattcacatttctaccagctttgtatgacagtaccatttttctacgttccaccagctgtatttggccaagctggtagacataaagtttaaaattttattttaatttaatttgtattcctgtggcttttcacgggtttgagtgtttttcatgtgtttaatggccatttggatttgagtgagacatttcaagaattatttttgaaattaaatatctgcaaagaaaatccaagtttttgccagccaaaggaaatcatcaacctcttctcagcaaatatatatttgtgaataacccaaaatttagtcagtttttcagatgaaaaatagctatgtttggtgtctgataaggctgttaccccaagccaagaataaatggaccatatttggtatcagcctgttcactccatgtggattcatgagccttattgcttggtttcttacttggtcccttaaaatcatctactgatgacaaattcattgcaggcttagggtccaagaaaacacatatccttgctctaggtacatagcattatcacaggggaaagcaaagaatgccctccattcacatatctcttgaatttcctctgaaaattttcatcagccatagagtgtccttactttggtgggagatgccattctatttcccatcaacagttaaatccaacaatgacattcctgaaatccagacccattccagggtctgaaggtaatggatcacttttttttttttttttttttgagacggagtctcactctgtcgcccaggctggagtgcagtgttgtgatctcggctcactgcaaactccacctcccaggttcacgccattctcctgcctcagcctcccgagtagctgggactacaggtgcccgctatcacatccagctaattttttttttttattttttagtagagatggggtttcaccatgttagccaggatagtctcaatctcctgaccttgcgatccacccgcctcggcctcccaaagttctgggattacagtcatgagccaccgagcccagcctgtaatggatcactttcaatactcagtaataaaagcagcaccttccaacctctgacctctggattttcaccagttttgtgtgtgccattccccaaccccttgggtaaacacagttatatgggtaatctcctttcacaagggtctaccaggcagagctcagaaaccaaatggaaagtgtcagtcctgatggaggcctggccctgggatgtctgagccagaggctccacactgattctatgctggatgacagtggactgccccacccatccttggccagatgacagtggactgcccttcttacctttagcttgtgtccctgaagccccaatgtgcttctctctctctgcagtccagcttgacctcagagtcaggacacatcagccaactctgcccacactgcctcctcatgagtttggagtcccctagtgcatgccctgctcatcctgaggttccccagtacctctgtttgtctctgaactcatcccccagtgcaggcccccattggcttttttatttaccccttacatttgtgcaaactaagcacactgtcagaggttgccatctgggtggaatggccaccaggttctagacggacatcttgttaactgcttttcaagctctcctaaaaactcttacagttacgctgaatccaagtgtcccatcttctttaaccagttccacaaagtagatttcaccagcactgatttctggaggtgatggaggacaagaagaaccagcaccctgccataaacaaacaaacaaaaataaagatgggatgaaggaagatgtcacctcttggctcatactgctctcaggagcaggcagcattgcacctcagaaagatcatgagttttggactgggccagcaggggattcatttccagctttatcaggccttctgcatgtgacctcagacaaagcaggaggaagatgagggagtgatgggctgggctgatgccacttctaggcagagaatgcttgggtcactgttcatgttccgctgtccctctgcctagaagatggggtcttttgtcctatctgccccctttacttagtgctttctaatcaccatgaatgttagaaaattctaacgacacgcaggaaaataaacaagctggaggaagctgaacaacgaagcctcaactgctgaggttgagacctgaagtgagaatctaaagtccaccataccacagaggatcatctggccacaaagttggccaagagacccagaagagcctgcagcatctgggttgcgtcctacagcctgcaccatggtcaacgtggccttagagctcccttgctcccctcaacggcccccagccccaggaaaccaactctcaggtttgccaccaaagaagccccagcatgaaggcctctctgctctgcttcctgccagagaggacctaccagaggaaggcctggggtgaaggtttctgctctggaggccaatctgaatcccagctctgtcccctgctccctgagagagcttgggtgtgctcctttgctctttctgtctcaggtaccccacccataaaaggggttgataataggaatgatctcattgggttaccatggagcttccatgagctaatacatataaagtgctcaggacactgcctggcacacaggtaagtactcaattaatggcagctactatcgttgttcttccactggcctcctgtatccagttcctcatgggatgttctgtccaggtgagcaccatggccaattaggaaggcactgtcattcatggagccctattgcatgccagatccttgtgacagaggtcaagacacactaccccaaaatagggcaccttggcacattggaggaattggagaaacagcacatgagggaaggtttctctgaccttcccctgcccttctcttctgaagcaggccctaaaacctaggaaggattttctaatcttcccccgaagcagggcacaagaccctcaagtgagaatgccctccctatatctggaaaaatggagcatcttatgtgggaagacacagggactgagagaggaatctgaacaagcaggccctgctgagttcctcccaccttacatactcctgctttttgtcttatctcatttctccatgactctccattcttcatcaaatatactcagggagaactgtttcttcaggtcatttccgtaagaaggctcacatgtcacataaaacttatagtaaatacacgtggatgcttttctctcattaatctgtctttagttacaggggtcccagctgatgaagctaagatgagtagaagaaagatacgggttttatccccgacactgggcatagtaccttagtttccacggctgtggacagacatcattatctccatcataaaaagagaaacaaggttgaaagaggtgcaataacctgcctgtttcaaccagcaagttgtcccagcaagaatgagaagggcatacactcagcctgagtaagggaggataggtcatgggagacctgttttcaaaggtcttgccagcctttggagaaaccagtaatatcagttcagcacctggggctagaaacactgggtgctgtgaccacccctgagcctgaagggcgagagaagggagtggtcgatggaccctcataggagctgtgctctttgtagaggggcacaggcaacctgtgtcagcacagggagagagtggaatgaagggtgtgcaactgagactccagcactgccaccctgtcctcactcatcccacaactgcgggctcctgctgaggctttgactgggcagaaccaagcagaacacagcaaggtgactcagtccatgagcaccagctgtgcagggcccagagcagaatggagaggctggggcatgggtctggcggggcctgagaagacaacaccactgggagtccaaagagacggcagaggacagcagagctgggactgaagcacacagccctccatacacctactccagatcccatcttcttcctccatggggtatggtcaagagcaaagccactgagttcccagcttgaggaccaattcaaggacaagaataggaggtgcctgattgcccacgccttgccattggcagcaatcaatttcctcatggtgctattatcacaacaattataattagtgactaaagactccagaggcacccacactgagcctgtgcccagacactgtcctagaactctgccttcttctatgcgtttttctcaacaaccatgccatgcaggcatttgcttctgtatgcaaatgaggaagctgtggctcaaacgggctaagtaacttccatccacctgacatggaaaacagagaacaggaagggcctaggggccaggctgttgggcttcacagtctgttctctttcatccagatctagaaagtaaaccaagggatgattacctttaacggcagaaaggaaagctgatgtctcagcctgggcactaagctctgcaccccagccatgtctagttcttcagtatttctgtcctggtcttgtgtgtgtgacaacaaacttccctggtacccgaagctcaggatgtctgtagaggagaccccagaattggctgtgctattcttttcttcatctgggttatttccaccaacacctataaaaacaagccaagaaaaagtcaacagcttaaaaaggctggtttcttggtggcatctctatgtgggcacagcgttttcctccagtgacagagtgatcgtttatagctgctcgggtacaatatgaatttagctcctcctgaaagatgttacatttagattagagaaagggaagattctacatgggatttagaaacctagatagagcttacgtgacccaactatgaatgcgtaggctcaaaagaagttcataaggccagctatcccttattaagctctagccatgtgatgggcaccttagatatacatataggaagatatggacatcttcccatcttctcagcaaacccaccaggaaggtgtaatcccagttcaaacatgagaaaacagagtcaaagctattaagtgtcctgccccaaatgctacagccagcatgtgggaactgtcttaaacccagcctctcctggacaccccactgagcacatctgcagccaccatgtgatccaaaaaccaatgtatcaggtccttttgggaggcttggtaataaccaaactgcaggcccctgtgagtgaaagctaggccactgattcctgctcaccctgtgtctgactcgtgacctggcatagaacaaagaaaagaacgtgaggttgctgatgtttatacattttgcatgtaattactaccatagaattatacacttaaaaatttttaaatgatgtatgtatatcatattgaaattttaaaaagcaaacaaataggaggtgcctaagcttgactcatgttcattaatttgctgacccctttattatggcagtggttaatatattttagaatttaaaattcacttaaaatatgtgttaaaagacagattgctgtttccttagtttctgattcattcatgctggaatggtacccaagaatttgcatttctaatacatttatgtatgatgtggatgctgttggtctgttgatcacacttaaaaaacttctagactacattatgcctaaaacagttcctctgtctcatcagtgcagttgtttaattgatttgttttttttttctccaagtaaagagattaagttattctaatctaataacatgctaatatagtttggctcagtcaggcaaaatcaatcatacatatgaaatcattaacagctgaaaagaaatagagagagacaaagttgggaagagattaaaagtgagagctgatgtgggattgcctggatgcaactaacatcccagttccatcacctttctcctctgtaacactggaacaggtaatgaacttccctgagatttagattcccttgcctgtaaaggagaataaataacaaaaattcctcatagagtattttgaggattacatgggatactgcttataaagttgctagcaaaatgtctggtacataacaagtcctaataaacagttacagatgaaaaaaagatggacagggaataacattcatgacaaatcaatctgaaaaatgttgatgtaaaaaattctagaactcaggatatcttcacaaagtcggtgtattaaaataaatatggcataaaccctccaatgtgagccttataaaaagaggagatttgcttattatgaaaaagagaaagagtggagggtctatgaggtaattattaatattagttttattaaatattagcacatttcattaagtgtgcagcaacctcaagctggtgttattaactgaacttgggagaacatttgagctcatgaactattcacattgttctaaatctaagtaaaaaagtgataaaagagagagtgcagaagctagttaaaatgtgttttccatatatataaatatacataatatataaataaatatatattatatataaataaacataaataaatttaatatttataaatttaacatttataaatatattatatattatatataaataaatatttataaatttaaaagttataaatatattataattatatataaatatttataaatttaaaattttatataaaaagatataaatatatatgtaaatatataatgtataatatatctaaatataaatatatttaataatatataatatatctaaatataaatatatttaataatatataatatataaaaatgtaaatatatttaataatatataaatagattatatatatataaatgtagctaacagttccaacaatgttcaaataaggcaaaggcccagctgcaaccaatccagttgtttctgtacctcactttccttttgctgtccataaatcttcttccaccacgtggctgcgctacagtctctctaaatctcctgtaattctgggcgctgcctgattctcccatcgttcattgctcaaactactttaaattttatatatatatatattttacacaaagaataggctgagttaaatatacatcttgctgtttgcagtgaccattctggcttatcattacagatgtcttgttttctcctatagaagtaacacactttactacttttcaagacagattgttacactgattctatgattgtcgttaagagaaaaatttcaaccaaattaaatgtaaagtagtatgagcaatgaatgatgggagaatcaggcagcacccagaattacagcacatttagagagactgtagcgcagccacgtggtggaagaagatttacggacagcaaaaggaatgtgaggtacagaaacaactggattggttgcagctgggtctttgccttatttgaacatggttggaactgttagatacatttggccaaaactcagtgattggtacagatgtgggctacagttggtttacaacttcacttgttatagttcacgatgtatagaaaaacctttaggttgaactttaatatgtaaggaggcagctttaggctaaatttgatttaacaatttccctctttgggtcattttctcaatcttgagatattgaccaaaactttagttattgatgttactattaccatggctcttgaaacttactgggaaagagcagaacagtgagtttggcaaagatgggaacaaggaccgagtagagggtatgtccatatgttggaacattctgtttacagaagaaaaacaaaacctggtctgttctagaatctgtttgctatgttttccatgatcaaacgtagtttgattatgttacattcagcacaagcaaccccagttttgtctggtttggtctgttggggcctagtgcatgagctcagtccaaaacaatggcctcccataatttcatttaaaagaatccccttttttttaggtcatgttctcacttaggtgagagtgtgaccaaacttagggccttagcaccactctcagttaccatcattgtggatttctggtctcagcatgtcattcataagttacggtgtcctcatggctgcacatttctttcagctcttgtcattccagttaaagagagaccatttgacatgctagagatgtctgcatgcaaacatttaacacttttaaagagaatatagcacaccagaaagactattattatgactatcagtaggataataccaagagtttggagtgtgctccttacccggggtccccataaaccaaaccacccaaaattaaatagatcaaaggatgagctacatgaagagtctactcacttaactaaagagtctcggccgggcgcggtggctcatgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgaggcgagatcccgccactgcactccagcctgggcgacagagcgagactccgtctcaaaaaaaaaaaaaaaaaagagtctcttcattaatcccctacaactaaatctataatatgtgatgttttccccataggccataagtgccagcagctgtacagatacttctgtttagctagtaacttatccagatcaattctattatttagcataactttcacaagagaatttaaagtttattgtgtaaccatagcctttacagtagaatctgctttagagcctatcatgaggaatacatttttaatctttgccgcttttattccaaactatggaaaaaggacctaacaaatgatgcccttttagaagagtgaaagcctcccagcgatgttctccttaacccatgatgtgggttaagaggagtaaatcaatgttctgtttctgactgattatgaggcaatgtacgtaccattaaagtttctcatctacattgggccttcatttttgtctattaaggtataaggttatccatgtataaggctggctgcaaaatccttcacaaataaaagtataccccataaatgcacacaagagaaccctttcacttctattattcatagaagcataagcaagggacaaataatcaaagataagagtctcatgatagtagagaattcttgatccatgatcttgggaaaacctgttcacagtcaaggatgccatcttctggggagaaacccccctggttagcttttctttaaggcttctaatgggtgtacagttccaagagtgtaaagggagccttctcagttgtgagattatgaacccaaggttcaaggtcctgaagttttactgtagtgtgcatgccaatgacagtctttctttgatgttctcagaagatcagtcttcaggttctagtttatgaaggcattgattgtcctcagtgaaccataaaaaccttactttacctggtaaaaatacactgtagtataattatctactgctacaaagatggcagtggcaccccatctggagcagccactgccgtcacatcagctacagaggtgaaacatggtaaagagctggatacaagtgggaaacatgccccttctgagttggtggagttagagcttcctgggaacagttgcagcagcccaagtagtggctgcagatctgggcctcccattccatggagcacacaggacacctgtccttcaagatgcaactacagatgcccaagccacggctgcagagtcaggcatctctacactcttgggggcacaggaaaaaaccccaggcccttgcagacttggaggtatcttctgctcccattgcctggctcctccccactcttgacatctgctctgatcttggagcaaggttgtgggtaggctcaggtgctgttgcagcctggtgggtgtgcacatgcttgaggcagtgctgatacaccagtaccatactgtctctggcccctgcccaggctttgggcactgacaagcatgggagggaagctgaggagatgctgagggcagcttggcactggcctgcaggcatcctttggcacaaatagcctgggtgccatgaatggcagcaggaggcagacaggctcctgcacagaagggggtgggtccttggtgaggcctttccttcaggccaggatgggtgtgaaggctggggtctgggctgccagtcccgtgaaccagagtgtaaacttgtgatgccttttctggggccatccatggcctctcatggaccgatcagtgtgcatttcttcctttctgagacctataaaagccccaggctcagccagaactgagcagacattgggacaaccagctacagagagcagctacccactccagggcctcatctcttctgagagatgcagatattgggatgcccagctgcagaatggaggtgcccactccaggacatcctctgagttattctgtcactcaatatagctcctctttgctcactctccacttgtctatatacctcattcttcctggaggtagcacaagaacttgggacttgccaaatgacaggactaaaaatgctgtaacacaaacaaggttgaaacatgccccttgctcaccatgttgtggatgacaagaagagagaagaaaaaaagagctgtggctctatgggaacccagacctgggagctccccaggccagagctgtgactcccgctatgggaccctgtggttcctggagtctgcaagcttccaggtacaactgtgttcccttgtaacagccatggaagctgcttgtggtgtgtctggtccagccaaagccttatagtgagctagcactcatgctggcacctggagctgcctgtcccagctgcagcagctggtgtgcctaactgtgttaaaatatattgaacaatatgaacttccactcaccaagcctgacttgattgctcagtctaccagtagcagaggacaatattgagcccctgatatggtgacattccctggagtaatcggctggctgcctgggggcaggctgattacatggtatgaatttcatcatggaagtagcagcattttgttcttataggaatagacacttactttgaatacggattgccttccctgcatgcagtgcctcttcccaaactaccataagagacttacgaatgccttatacactatcacagtgtatcacacaccattgcgtgtgatcaaataagtcacttcctagcaatagatgtcagcaatgggcccacgcttatgatccaatggtcttaccatgttccgcatgactctgaagcaattggattgatagaatggtggaatagcctgttaaaaactctgctgcagcaccagctaggtggcaatgtcttgcagaattgggacaaattctccagaaggctgtatatgctctgaatcagcattcaatatatggtgctgtttttaccatagcagaattcatggctccaggaatgaaggagtgtaaatgagagtgacagagttcactattacttacctgtagtgactcagtagcaagatggttgcttcctgttttcatgactttatcatataatatgagatgtactgaatttgtttcatagtatttaagtaatcctaattttacatcatagtatttaagttaggggatatcaagaagagtaaacattactcaatgactttgcttcctctttctgggaagggattagtgcaatttttggtgtatacaggatagttgtatcctgtcaggcagaattatgaccttgctattgtgtttatttgaaaattaaatatggttttaaaagatacatataggtgccacattgacacagaataaacttataatagctagttttatgtgttggcttgactaggccatggagtgctcagatatggaaacaaatactattgagtgtatctgcaaggatgttctagatgagattgatatttaagttcatagagtgagtaaagcagattgttctctctaaagtaggtaggccttatccagtcaattgaagacctgaatagcacaaaacagttgattaagggaggactcctcttgcctggcttcctgagctgggccattggtcttttcttgcttttatattcaaatggaaacatggattttctcgggtattgagcttgccagcctttggactgaagcttacactatcaggtctggttctcatgcctttggactcaaactagaactaaatttcagcttttctgtgtctccagcttgccaattgcagatattgaaacttatcagcctccataatatgtgagccaatttcttgtaatctctctttctctctctctccctctctctctctctctcaatattgagagcagtatacacagctaagatagtcatggaatggacatgatgactctattactcaatgttatctagagaaacatatgatgagcaagaaaggataagaaattggctcacaccatccttatagaggctgagaagtctcaatatctgtagttggcaagctggagacacaggagagattaaatgtagttccagtttgagtccaaaggcatgagaaccaggagagctggtagagtaagattcagtccaaaagctggcaggctcaatacccaaaaaagacaatgtttctatttgaaacattgaaaaggaatcctctcttaatcaactttatttgtgctattcacctcttcaattgattggaaagggctacctacactagagagaacaatctgctttcctcactccatgaatttaaatattaatcttatctagaacatccttgcagatacacttaatatcatttgtcagcatatctgggtacccatagcctagtcaaatcaacacataaaattagctattataagttcatcccctgtcaacctggcagccatgtgtctcctaaaaccatacttaattgtcaattaaagaaaatagcaaggtcataattctgcctgatgtgatacaactatcctgtggcaaccaaaaatgcactaaccccttccctagaagaggaagcaaagtccttgagtggatgagggctgcctactttgaatatacatggatgtgtataaatacacatttttttctgttcctctagataaccttgactaatacaatcatcatgttcattccctgactatcttagctgaaacagagactaccagtcagtactcttattgcccccgatttgtttattgaatgtacttgctaaaatccaaaaaatacaaatttacttattgtctacatcaaatataatgcaatcactatgggagtaagtactttgtatctctttttacatcacagaatagattgcataacataaaagtgatgctcaacaattacttgttaacctagttttgattaaaacattctgtagagttcaaaaggttctatttttgcatatatgttccctttgtttttataaataaataaattatattaacttaaaaataatggatataatggctttgaaaattctgagactcaccagatggcaaatgatgctgaaatgaataaatagctttcaagcaaagatagaatccagggcactgccaggaaagtatggtccaaaattgtagccaaaaagataactgtaaaattttccatatgttgcaggaagatcaaaggttgtgctttggaatgccatttagttagacatacggtcctctaaaatataaagtatatgatatacagataactcaatcgaacaatggaacctgcaggaagctcacagcattgctctgcagcctcctcaacaaaagttcaagaaagagaagggcatgtttctgaaagtattactgagttaccctttgtgtatgagtgaatctcagtaagattcacagtaaacctacaaaaatttgaaggtaaattacatatgtaaaaatattgataatttaaactgaataagccagattcattttaaagtgggccacccaagtttctttaagcagatagcaggctgagtaaactactcagagttaaatatgttctaacttttatgaaaaagtaggctatttcaaaggataggactgagaccagacggtggaatcaagaaatagccattgattggtaggaataggattaaattcccctcaaaaaaaaagaaaaaattaacattttcccagctagatttcagaactctcattgactgctgacttctgtatgtctccctttttcctctattaagtccgagtgtctatgatgattattctatgcctgtctcatcattttatgatagatgtgtgaaagataggtaagttgtttctttagtttcaaaggtcttcaaatcaagacaaactgtactcaaggagttgtatttgcagctagacctgatttaaatgacaagattctagacttcaaactaatgctgtgatgagatgaagctttggtagacttaggatacaattagtgaggtgtgtgcattacttggagccagagagcagtctacagtaaccggcctctaagaaggaccccaatggacattacctccaggtattcatgcactggtatagttgcctcccgcagtgtaccagggttcatctatatgaccagtagaatatgccagtagtgatggtatgtcatttctaagatgatactatttggcactcaagggttagccttctgggaaacatagagtttgggattttaaatttagaaactgaagcaacttttattctggtagttacatgctctcattactgcttctctctatatatttctaataataattaatttaattaaatatcttcttcttctcaccatacaattttttcatattttactattggtaatgattttaactactacagatgtggtctgtatctatctgcctatttatctgtgtctctacaagtgcataaatgtgtgtgtggtgtgtggaggggagtgtatgtatatgtgtgcttataagttcatggatgaattacaaagctttcatatgtgcatttcagtttactcagaagttagcaaatttatttttggacattttaacctctgtattactatgaaaagatccacatttccattttcatgtaatctctttctttctccctctgtcacacacacacacacacacatacacacacacacacacaccccccacactccaaacaattcttcatttgtgtagatttgtgtattaccctcttcttggttttgtgtctctaaattatttacttaaatattaagttagttaatttaattgtgttccccctctataatttccatatacggtttacctttgaaccatataggtttgaactgcatgggttcacagatacatggattttcttctgcctctgccatccctgagacagcaagatcaatccctcctcttcttgtgcctcagcctactcaacatgaagatgatgaggatgaagacctttatgatgatccgtttccactcagtgaatagtgaagatcttgtaattctcttaataacattttctctcactttctttattgtgagaatgcagtgtataatacatataacatgcatgacatatgttaattgtttatgttattggaaaggcttctgatcaacagtaggctattattatattaccagcagttaaagtcaaaagtgatacagtgatttttgacttcatagaggtcagcaccctaaccactgtgttgttcaagggttaactgaaaacgcactggattgcatgagcataagataataatgagaccttaactactttccagctgaggtaggggaatttaaattctgcataatatctgctgtcaatagatttgcccagtaaagttttgtatcaaataagttctaagtcttatttcacatttttatctcagtttctaaatctgccattattacattggatttaggagcaaaatccattataaaaaacctgttctaacaagaagactgttttttggtagtctcttaaacttcatattgggtgaagattatgctccttgaggataagattcatactgtaacaattttctatatcctccacaatgttttgcagattcaataactatttaatgaattaagttaaatttacctatactcttacaagtcttactctcataaataaccttctaatccgcaattcctctaaaacatacaaaaaattgccaatataaaaaagcaagaaagaaggtgttaaccattttgtcattcaaaatatgactcattctttcttatacaactacctttgtcagcattcttgccattggactgtctagcctttgacactgttatatcatggcttgtcgttagagaaggtaaagtttggaaaaaagaagcagttacgtaaagcaatgttagaaaatccttgagtttcccttagaattttgtgtcttctacgtgttttctatttcacatagattaagtttgcagagttgtgtcataatttcatgagtgtatctgtcaaagagccctttgaaggcctatttaatccaactaagaccattttttcttgttttaataccattaatcttgttctctctttgataactgagggaaaagagaaagacattccatataatacatcagatgcctaagtgctttggatagtcataagccttttctcctatagcttcctaattagaaatgcctgctctgcggagttttcttaagttttccaacttgctccttccattttataatagtctattgaggaagactattatcaaataaaaatcagaatgatcactggacacctattttagccttgggatttatatcacaattccctaagacttcatatttccagaaaagaaattcaaactaaagctcacaattactattattatggtaatcctgataagatgtacattttaactaaaagaagttcccactattttttttctttctacttttcaataatccttgggaccttagtaggagtgtgcaatagtcttgtggtgtatttttagtttaaaagtctatctgattaccacttggtagatattgtccaaactcacttttgaatccaagtgtttttacccttatataatttttttaaaagagtatttgcttgtttctattatactataactattggagctactaggaggccttttaaatttcaacaacaaataggcagaatggagactaactgaagggttgatgggcttaaagaaaataaataacctaacaaaggctaatggcaaaaccaacattagaaaccaagtcactttacttgggattagtggataccaaaatgtgctttctcggaagcagcactttacaaggaaacatgaaaatccacctttgttgtccttcagctaaagggaataaaatcgtgtactttctgtaattttaaccttgttataacagatgctacagaaactcaagtggaactctgactgccttgagagctgaataaaatgcatcctaccatccattgctgctgcatcaaggtattaaaaagagagacagaaggaagaggcgagagaggcacaagttcaacagtgtgagggacttggacacaatgggagggagaaagaaataaatgtctaaatgtcatggaaagaacagacaatgaaggcatatgtaagaggcctgctaaagctatgggacctcagaagcctatttgtaagaactacaatttagaataaggaacttgcaatacaatgcctgaccttcatttccttacgtgcctcaatcttgtcaaaacctttgattgatttttgtatgaacatgaattactgctacaatactcagttgaactacatgaatttctcaaagcagtaatacagtgctatagcgtagcttaacattgtttaagtaatatggtttgcttatatttaagtcatttctaagggacccatgcaaacacagtcaggagatctatttctgatgtatttccaaggctaaaaacaaaaaatgctgttaatgcataaacagtcaaaaagctacgcattgtggttttacagggacttctatttctaaagatgatggttgcatgagggcctctgcctttataagggaaatgtgtagattttaactagctctgtattataatgtttgtgttttgaaaaagaaaagcatgtttctgcactaaaaaataaattcctaatcaaacctttaaagttaacatttagaacagggacagaaatttctattgtttcctaagtgttttgttgctgttgctgtttagatttaaatcattttttagaagttttactgaggcataattgatataaaaaattgtacacctttaatatattcacttggatgagtttggacatgtgtgcatacaccaataccatcatcacaaccaaggtactgaacatacttattcacctccaaaaattttcttttgttcttttttaatggtggtagtatatttttaagaattcagcctttgagcagggtatgaaggaccttcaacaacaaatgcaaaagtaaatgagctaagttcatataaagggttagctctcagtgagatattcaagttatgatcatatcctcaagaggcttgtaaactgactgtgggtttccagtttggttattcacagataggccttcatttgctcattcacctattcattcatatagccactcattcattctcaagaagaggtatttgtccatatctcaccatgtggatgagcagatggtcagttctcacttcttttgccattaagtgtgctcaccgttgagctccaggatggtattttctctcactttgcgtcattaccaaagtggctatcaagattccctcccctaccttctttttcttttttcaatgtttaagagctggagttaatttcttgactcctttggtaacacatgccgatatataccactcaaggcctgttggattaaactgttaaatttgtcatctagctaatgttttctcagaaccagacaaattaaacagagtcaattgttgaaattatttcaaaagataaacaatcatagaatggaaataaactacagaaagtagggaacaggagtaactaagtctcctagaaaacatttgcagcagatgttaagtatccagtctcgttgttataaatgaatttcaaagaatctcatgaggagcagctttacaaaattttactgcactaacaaatggcagccaacatctgtagtaaacacaaaatactgtaccatcctttgtatctccttaaattaagccaatttctgcttacacagaaaatctgtctgtggaaaacactgcttagaatttgaaagcacattaatctggaagccacaacagaagtgtgcttcagaaaacttcttaatgtttttcttgtgagttattctctttacgcttttcacattacaatattaccaagttatcataatgtattttctgcactcccagagcaagataagactctagttgttgctgggaactatacattgtctaaatatgggttcacattctctcacagtgattctggaatcatacacacaaatgagatcactgctgtcacatcactggaattaagacaacctctctactcactggccatgtaaatatagatacagtactcaaatcctctgaggcttagctaattattggttgatttggtctacacttaccacattaactatttgaaaagattcattgatataacatgtactaagaacagttcctgactcataatcattattaaggcaatatttaccaatatgtgacattaaaatagatactactattagataataattcatactatacattcaatatttaagcaacagaattataattttgtgaagtaaattttgtactcaaatagaaaatctaattctataattattttctgcaatattgggtcatagaaccaacaaagaatatgtgactagcttagacgtatgtatttacttatgtgattagtaataaaattcttcactcattcctaggtttgaatcccagatgctctgtgtagcagctgtatagtcttagacgagttgcttaatctgtctgtacctcgatttcctcatttgtactccaattttcttatgtggtaaatataaaattacttaactcagagctatgaggtcagttttatttgagagaatccagaaaaaaaaaaaacttaacacacatttcctaccattcggcatgcataatacgtactcaaggaaattttagatctctgtacatgattaatatattaaatcctcaaaccgactataaggtctgaaaatgcatgtctttatgtcactgtacctctcattgcacttggcacagtgttgtgaatatatttgtcatttgtatgttctttctaccatacaattctgccactccaattagcatattgtgttggaaaacaattgagtgcttgccttatgttttactaaatttatatggaactacgttgacacttccttgcccttaagatgctgggactcactggttgctttctagttctcaggagtctctatgtgactctgtcctttacacttgccctgcaacatcaccctcagccctagacaaagccaacatcatttttaaaaacctgcaaatatgtctgcaattcactgtatgaatattctcattctatcaaaaccctgacctcactaactcaatggagcaatataggatgataaagtagtttatatgaaagtcatagaaagtttgctttgtttattcacccaaaggtatgtttttaaaggatgaggcttttatctgaaacaaataaaattataatttgaaatttcaaataatgtgactaatagattatgaattcatttccaaatatagaaataattaaaatacttgggggtatagaaaaagtgagtgctgtatctattcttttattatattaattttaccctagctgccagaatttagtacttttaacatcaactgagagatttaaggctattgtaattttcctattttgattttcctcttctatttataactcaaagtaatttgataatatacactgtgatgtgtccccatgtatcaaacatttaaaaaatatatttggaaccaaagcaaagatacatattttttttaatttaattttttttttttttgagatgtcacccaggctggagcgcagtggtgcaatctctgctcactgcaagctccccctcctgggctcacgccattctcctgcctcagcctcccaagtagctgggactacaggcgcacgccgccatgcctggctaattttttgtatttttggtagagacggggtttcaccgtgttagccaggatggtttcaatctcctgaccttgtgatccgcccgcctcggcctcccaaagtgctgggattacaggcgtgagccaccgcgcctggcgcaaagatatgttttactaataccacagaggtataatctgctgctatttcttgatcagaagtaaacaagtgtcttcacagcagttgatctaattttcttccccattcattcaatggtattttttgattattatagaatatattgaattagataatgataagtcctttttctttttttttcagaaatggcttctctctgttactgaggctggattgcagtggcattatctcgactcactgcagcctctgcctcctgggctcaagaaatccttcgacctcagcctcccgagtagctgggactacaggtgagcaccaccatgtccacctatataatttttgtatttttttttttttttttttgtagagacagggtttcactgtgttgcctaggttggtctcaatctcctgggttcacaccatcctcctccctcatcatcccaaaattctgggattacaggtgtaagccactgcacccagctgagaaggctttttattataggttgttcttattgttttatttagttggttttcaaggtaagtttgacatataaggtggtataatgtttaaaggtcaagttatagagatagctagattgaagttcaaatccagagccaagttacttagactctctaaggacttgttttttcccttataaaattaaaataaagtggatagccacttcataggtttgtaataagaattaatatgatcatgatgtcacagagttgcaaagagatactgaaacttggctctgccaaaaaatattagctattgccattatgattgttctccttaatacctaaggcatttgctgacaatcaggttactcatcatgtccttccaggaaaaaaactttaagaatgttgaaaacttaggaactacttttaaaatttaattttcagacctgacataacacagctgaggaagagaggtggtagctgattggggatagatgtagagatcattaatggtataagagtgtgagaatgtgaagcaggataggatatgatattactcatacagatcacaaatacatgtcaaaattatatttatcattcatttaagtaaaattcaacattgttttcttcaaagaagaaattgcgcatttcactctacctatttaactctggaaaattttacaaactgagcatgccattttttagtatgaattcctttatttcagctgccctgctaactttgcatgatgagcagaaaaaaatgaaacagaatggttagttctggaatatgaaaaagtatccaagaagaggagtagtcttgagaagtagggaacaggatgaagtcactaggggacagaagggtaggagggagtgggaccagacaaacactgagctctgcatgcacacgtaacagtctaaaatagtcatccagcacgcagactctaggtcaagataaccaagatgaattgcaacttctccacaagcaacatgactttgggtaaggtatttaacttttctgagtcttagtttcttcaactgataaataaaaatgatggtcatatctacttcataaaattgtgataactgattaatacatgtaatgaatagtgtttggcatttagcttaataataagacatttcattaaaatattagctacttttgttagctagcaactctcaattttgcctaaagctgaccccatatctagggttaggttttgaaagaagttcatcaccatcagaactaggtctggaaattataaaggaaagcttaaaaaaaaaaccagaaatatgtgcaacacctatttacaaagaatccactgggaaacccccattgagcccaggtagatggcacatgtcccctttgggcatgtaactcagttccctgagggtcagtatattgtctttgtttcaaaggtcccaaggcaaactttttaataattgtgatcccactcaatagtcatgttcacttactttgtgggtacatttgtggcatattttaaaatgtgaagttgagtgcatttcacttaaaaaccaaaggcatgtaatgacaacatgctatagaggaaaaattattgatttgtgtaaataggcagatcttgtttgtattctagctccatcacttactaattttgtgatatgggcaatttatatcctatctgagcctgtgtttcctctacaatatgagataatttctactttgaagtactgttatgagggttaaatataaattactttctggtttatgatgttggtatatactatttccatgcatgatagttatttttatgaataagattttaacagtaagccatagaaaaatacaatgtaagactgattcttagaatctatcaaaacaggttgtaaaaatgacttaaacatctagcatggcagtgactaacattttgaaaagcttaatttttccattgagaactgtagcccaacacagtgtctgtgcctcagtgttcctcttatcaggaaggataatatctgtgatgcatggactaactctaatgaaaatttttattcttaagacacaagatatttcccagcacagtacataaggtctttgtgctcatgtcagcattggagataaatttctgggaaagaagtagagaaaccgctcatttctatagacatcaaaacaccaaagtaaaagtgaaaataaaggtacgctgcagacttttttttaaatgcctaaactaaaaagtatacctatcaggaaacatccaactcacaaattgctttaaatatgtttttaaaacagtgtgcttgttttataaccacagattcatgctatttatctgatattcccaggtggttgctttgtggggctcagtgccatccttggagcaataaaaagcatttcttctacaccagtaaaaaactggctacttctcacataaaccttggagggcttccctcagtgggcttagtgatcagcaaatcatgtcaaataacccttttggttatttttgacataatagtgttcctagcaggcagtactcaagaattcccagattcttagctttaaattcaatatactctcttgtattaaaagtcaagctatttatccacagtagttcttaggtccacgtttcattttacacatatatgtggatgtaacagctttttccttagaactttttaaaaaaatggaattcagtaaaagtcctatatttgtattttctatgtgccaagaacagataaccatcattaatgtgagccaaatttgaattgaggagctgaaattaggaggaattgaaaaacacctgaaataaatcttcaagtaatgaaggggaaagtttactttagaattagtgtatcaaaaatgagaaaattggctgggtgcagtggctcacgcctgtaatcccagctctttgggaggctgaggcatgtagatcacctgaggtcaggagtttgagacttgcctggccaacatggtgaaaccctgtctctactaaaaatacaaaaattagccgggcatgatggcacatgcctgtggtcccagctacccgggaggctgaggcaggagaattgcttgaaccacggaggcagaggttgcagtgagccgagatcacgccactgcactccaacctgggtgacagagtgagactccttaaaaataaataaataaataataaataaacaaataatttaaaaaagtcattgctttatttttaaaaaagtaatagtttcaaaatgtatacatgtaaaatctaactgggaatactttgtacctacttgtagcccaagattaagtttattctcaattactaggaggtttgcacaatagagtacatatttaatctgtatgactaaaagcctcattgtcaatgtgactgtgtcatcattatcacatttgtgaatctcctgattataactttcacagatggtctatctacagggttctgggataagaaacttgctgtctgtctacagaggaagctgttttcacttccagatagttctgaatatttgaaagtacttgctgattcagagtcaaattatgtcttgctgtaacatccacaatttctgaacttacatttgagataaaccaagattagactaaaccatgccttcaagtgacagactctcaaaaatgtgatgtattttttttcaaaaaaaactgcacgtccaggatactctacctggagaaaaacgtagctctcattaaccttgtccagacattaaacttataagagaaaatcattattttccttgtagccaaattattccgctaaattgtttttaggcaggattaataaacctttactgtaaagggaaagaggctaagatcttaggttttgtgggccatataatctctatacaactattcaactctgctgttgcagtgagaaagcatttatagacgatacacaaatgaatgagtgtgtccatgctgcaataaaactttatttacaaaaccagtctattggctggatatggcttgcaggccatactttgccaacccttggtttacagcctggctagctaaacactgcttgttgtagtaaaatcttgctttttaaaacatatgtctctcatcctagcattgtcattacatgtgtgtggtttattgttgaatatgtaatatttaaggatctttcctatttagttttattgactaaaagctgtttcataattataatacacagacatctatataggtttttattttatcattcaacctattagctaatccttagagttgtttcaattttcatgtgtttgacagatgaacatgtctaaaacactgatgaaaatgttaccagaatataaacaaaaatgaatttttccggttaaaaccattttacttgttagtaatatgtaactattaaccattaaataatttaccaaattattccattacgtaatccatattgctccttcttgtccacaagaatatagtaaggtacattatcaaatacatacctctgactttagtgggcatttaatgtattattagaggatcccaatatctgtctttcttaagaaaattaaactcatccctagtgattatacactttcttcatctaacactataatattaataacatttgaaaaaataatgtctaataattaacactagatttagagtatttttagacaattttctaaaattatctgaaaaatttgaccagaatcattgtaaaattcacatctgagcttatgaaagcccactttattccactctaaaagaacaaaattttgtacttttaattttatcttttaaaatgttttaacataaaggtagtgggagacgttactaaaggaagcttaggtagtaacgtatttgtcgtctcagttaacacaaagaccatagatggggcagatctgcaggatgcaaaaactttcctttttctcacctcatagtagtcatatggctactgcaattctctggtttcatgtgcttacaaaatgtcctttagttaaaaataaaaagaaagagaaagagaaagacaaagaaagaaaaagaaagagaaagaagaagaaaagagaaaaaataatttcttcatgtgtctatttaaattaacaaagacgtgaattgtcccagacctccctgtgatgattaatttcatgtgtcagttttactgggctaagggttgcccacatggctgataaaacattatttctgagtatgtctgtgtttccagagaaattagcatttgaataggtagactgagtgaagaggatcatcctcaccaatatctatgggcatccttcaatctcttcagagcccaaataaaacaaaaaggcagaggaagggtgaatttaatctgtcttcttgagctgggacatccatcttctcttatcctccaatattggaacacctggtctatgttggtaggagtgtaaattagttcatcataaccttgttggcactagggaccagtttcatggaagacagttttttcatggaccgtggtgtagggaagatggttttgggatgattcaagcacactacatttatttatttatttatattattattatttttgagatgaaatctcactcttgtcacccaggctggagtgcagtggcgcaatctaggctcactgcaatctccacctcccaggttcaagcaattctcctgcctcagcctcccaagtaactgggattacaggcacctgccaccacacctggctaagttttgtattttcagtagagatggggtttcaccacgttggctaggccggtctcaaactcctgacctcaggtgatccacctgccttggtcttccaaagtgctgggattacaagtgtgagcaaccatgcccggcacaggcacattacatttattgtgcactttatttctattattattacattgtaatatataataattatacacctcaccataatgtagaatcagtgggaaccctgagcttgtttttctgcaactagaggtcccatctgggaatgatgggagacagtgacagatgcacacactgcagggggattgcattagatcatcagacatcagattctcataaggagcgtgcagcctagacccttcacatgttcagttcacattaagattggtgctcctatgagaatctaataccaccattgatctgacagcaggcaaagctcaggcagtaatgcaagtgatggggaatagctgtaaattcagatcaagcttcgcttgcttactcactgctcctactgctgtgtggcccagttcctcaccaggccatggacctagtccatggcccacagggttggggaccccgatctaatgtgacaactctggaaatcagattctataccccctatttgttgttgctgttgttgctgctgttattgttgttcagtgtctaatgagctttctgaaataattttgtagtctgggactactcttcaacactcagccaggcagtttacatctctgccttagccttcacttcctgcttgcccagagcctcaaggccagtcagaggtgagagctttgagccttcccaggtctttactgaacatgtacgcaggcctacacttgggagtagcctcatagatttctaggaatcattctgttggaattttcaaagcccttatggacatctcattctcctgttttacttttaaagctttttagttagcctattgtctgcccaaaatgttatctacaacctcatacaggcaccaacttgaataacggcctttaaatgtttttgacaaatgccattaaggaaaaggctttttcgttaagtgagctcttaggacagaaaaagacatcctggcagtgggatgtttctgaaaaccaccagccaagtcaaatgacagttctctgggaatgaggctttgaaggaaatccagccccattctgtctttccagtggctgccaggctattggtcttcactgtaattatgggctgttaattttcaaggctgcagtggagccagcgaggagaggatgagaatagaatagggcaagttaaaaataccatactgcttgctgttcttaatgagatttttcattttatttatttgtgtgtgtgtatatatgtacacacatacacacacacacacacacacacacacacacacagtgaatggaaaataaatcttggggccccaaaatcactaagctaaagggaaaagtcaagctggaaaagggttagggcaaacctgcctccaattctattcaaagtcatccctccattcactgagataaatgcatatcggattgcctcctttggaaaggctaatcagaaactcagaagaatgccacttgtctctcacctacctgtgacctggcagccttctcactgcttgtgctgtcccacctttcttggcaaaaccaatgtatatcttccatatattgattgatgtctcatgtctccctaaaatgtataaaaccaagctgtgccctgactaccttgggcacgtgtcatcaggacctcctgaggctgtgtcacaggtgtgcctcctcaaccttggcaaaataaacttcctaaattaactgagacccttctcagatattcaaggctcacattttggcaaccatgaagggattctgggtggaggctcccctgacctttgacaaatctcctatcagtgctcggtaccagcttgaactatctttatggctcaaaccaatagaacaatttgccgagacaggcctggaagcaccccctccagagaatcactgatctttcaaaacttggtcaagatctaaagtttattttgcagtacaactccttttttttggagttttactatcttccaacgcaagaaaggcaagtttttcctgctttgatgacgatgaaatgcaggtaactcctttatggagtttgagcttgcttccaacggggaagacaaatgtgagtttcttccttcttctagtaagggaggagaccacccctcatatcgtcttatgcccaatttttgcctccaaagaaagaagtaaaaactaaaaggcagaaatgaaatccacaggcagacagcctggcgccgcaccctgggcttggtagttaaagatcgacccctgacctaatcggttatgttatctatagattacaggcattgtatagaaatgcactgtgaaaatccctatcctgttttgttccaatctaattactggtgcatgcagcccccagtcacataccccctgcttgctcaatcaatcatgaccctctcacacgcacctcttagagttgtgagcccttaaaagggacaagaattgctcacttggggagctcggctcttgagacaggagtcttgccgatgcccccggccaaataaaccccttccttctttaattcggtgtctgaggagttttgtctgcagctcgtcctgctacactaggatggtaaagagcagtcttcagcctgagacccatcccttacctaaggatgggtaactaaactgggggttgtcttggctaaagttaagattaacaaccagctggttgtaatttctctttaccattagagcactcagtagttggataagttgtgccatctttgttttgcttaattgtttttgttgttgttgtttgtttgtttctgtttttgttgttgtttcagtctttttgccattgggattgatcaactctatccgacttgatcaaatccaaaggaaacttccaaattatggggaacaagacctctgaagtggctaaatttccacactgtggtgggggagaaaaacagccaaaaaaggggaaaaaaaaaaacagggaagattttttactttgactacttaaggggctttatttacataacaaggccacctttttgctagccaggccaaactgaaagagcaatggctgtcactccatactgcagttccatagctaagggctctggcttctttttttccaccacgacagcttgggtgtggttcctaaatcaagccatttttggtttgatacttggtacttctgaaatagcagcaatttgttctagctgaattatggtaatgagattttaaaagatttttttaaaggagctcaatgattaaaagtcagcttaactaaaagctaacatccaagatgtgtgtgtgtatgtgtttgtgcatgtgtgtgtgtgtgtgtgtgtatgtgtgtgtgtttgtattgaaaaggccttcacatatttttttttttctcctaggaccttgtctctctttttttttttttagttaaagatttttttttctcagttgactgagttctgttttttgttttgttttgttttgttttatttacttctgctgcctctcctttctcttgcaccctctgctgcttgagggacctaaactattatagtttataatagcctggctttccttcaagaaagcagagaaggcaccagactcctttttggggagaaacctgtttttccttatgaaaccccaagagtgtaagcagataagttcatctcagctcttaaattgcctgcttttgtattgtgttacctgacttattgactaaaagagttgttgcaccaaagcctcctctggtttttaaggaagagtgtagtttacacattggaagtgtcttcgtttaaaaaaaaattttaagtgcactgaaaaagcatcacatggtctagcctcataataattctcccttttgggagattcaggattcagtgtgggctctgcccagagctcagagatctagtcaaaagacaggtatttcctacataaataaaattggtctcttcatataatcctatgacagatttctttttttttttttttctgagacagagttttcgctcttgttgcccaggctggagtgcagtggcgcagtttcggctcactgcaacctccacctcccgggttcaagtgattcttctgccttagtctcctgagtagctgggactacaggcgcccaccaccacacctggctaatttttgtatttttagtagagacggggtttcaccatgttgggcaggatggtcttgatctcctgaccccaagatccacctgcctcggcctcccaaagtgctgggattacaggcatgagccaccgtgcccggctatcctatgatagatatctgtaactttatgtttgatttggcatccctcttttgttttgttttgttttgtttgagacggaggctctctctgtcacccagcctggagtgcagtgacacaatctcggctcactgaaacctctgcctcccaggttcaagcgattctcccacctcagcctcccaagtagctggaattacaggcatatgccaccacacctggctaatttttgtatttttagtagaaacgggttttcaccatgttggccagggtggtctcgaactcctgacctcagatgatctgcccgcctcgacctcctaaagtgctgggattacaggtctgagccactgcccctggtgtagtacatggttttactgcatgtgactagtttacatgcaactagccatgcaagttcagtaacccaaggcggtctataccctgttcaacaagaaccatctactaatgacacttctggaagtctgggcaatgtcaacttgctgtaaaagttcccaaatgctctcaattatcatatgataacaaaggtctcaaatcagtaaattttgagtggccctttactaggaataatcttgaataagctagtactgccctccacaaccacaattaaaaatatatcggtattggttttctcttcagttcaagaatcatgtaaatatgtaatgtagaaaatgaggatttcccatattcccacagaatcacaaagatgatcactggtaatatgcgtgctacatatatgataccaggtttattctactctttttttttttttttttttttttgagacagagtctcactctgtcgctcaggctaaagtccagtgctacgatctcagctcactgcatcctctgcctcctaggttcaagcaactctcccacctcagcctcccaagtggccggaattacaggcacctgccaccatgcccacccagctaatttttttatatttttagtagagacgaggtttcactaagtagaccaagttggtcttgaactcctgacctctggtgatccacccacctcggcctcccaaaatgctgggattacaagcatgagccaccatgcctggccatttttttgtacttttatacaattatatgcttgctttataaaaatgaacttattctacatatatatgttattacattattaggacatgttcccaaatgacatattacattttcatcattcttttttaaaatattttttcgtgagacagtgtcttgctctgttgcccaggctggagtgcagtggcctaatcacaggtcactgcagcctgaaactcctgggttcaagggatcctcctctctcggcctcctgagtagcccagctaagtttaaaaaaaatttttttttggcctggcatggtggctcacgcccataatctcagcactttggaaggccaaggcgggcagatcacttggggtcaggagtttgagaccatcctggccaacatggtgaaacaccgtctctactaaaaatacaaaaattagctgggcgtggtggcaggtgcctgtaatcccagttacttgagaggctgaggcaggagaatcgtttgagcccaggaggcggagggtgcagtgagtcgagatcatgccactgcactctagcctgggtgacagagcaagaccctgtctcaaaaataaataaataaataattaaatatatatatatatatatatgtatatttggagagacaggtctcactatgttgcccaagctggttttgaactcctggactcaagcaatcttcccatctgggttcccaaagtgttgggattacaggtgtgagccaccatgcccagacattttcatcatcctttttttttgagacggagttttgctcttgttgcccaggctggagtgcaatgtcacgatcccggctcactgcaacatccacctcccaggttcaagtgactctcctgcctcagcctcctgagtagctgggattacaggcatgagccatcacgcccagctaattttgtatttttagaggacacagggtttctccactgtttttactagaccttgatcacatcaaaaagattgtgtctcttccatttattgtgcagcttgtacacaattgacacaatgaggagctcagcaaaggacgcagagtgacagcatcctcccttcagtggaatggccatgtctagacacctcttaatcactcccgagaagtagggatgggttcggtgtatgagaataagaaacggagcctccagggttgagacaatttgcccaaaacacacctcttgtgggaagtacagttgcgatcccccaggtctcttgggcttgcaggttcctgctctcccgtgggcccccaggagatgttggctgccaagaggaggaggaatcctcctgggcagaggttaacttttgccactccaggatttgcccaccctggggtccctgccaggaatgttcccccagcaccaccctccccatgccgcctcctaactggctgtgtccttcccaccattcagcaaacacatcctacgtccaggaccagccccttcatctcaggaaggctgccatgggactcccagaacccccatggctcctggagccctgagggaatcacatcttgggtggggagtgatttgttttctcatccagtgcaaccttggaggtaacagtcaagaatgtcctgtgatgcgaagcacttattgtcctgacctctggtccagtgcccttcgctctaagcacatagcatccccaggctgttcctggaggcgtgggctggggtttgtagggactagctggaccagctgggccaggggaggcagccatgcccggggcacatagccactgtccagagctgcccccagagctgggagccatcttgcacatggtgctgtgagatgccctccagagaggaagatggaagctgtctccgtgccccgggactgatgaagggcccattccaggcctttgggcacccgggctcgctacccttctgggagccctgtcctgtgggccaggacaaaggtgccctcactggtggcattctcagaagctcagccgctccccacacatgcacataggggcgtgcccacaccaagccacgtgtgggtgtctggggacaatgagtcttgggggagggggtgggtcccttccagaagggtctggccaaagtccagttatgaaggtgagctgagatgggctccctcaaaggagccatagtgtggggagccccgggcagagcccagagagaaatgccagccccgagaccgagacacgctccaaggagtgctgccaagagcagtagacacagccgctgaggcccacggggcacagtgaggctgtgggagagggtggcccctctgtggccatttccctgcctgtgctcacatcccctcctcaggcctgtctcaccagctcttgcagcccatgacccacattctgtctgactctccttcctctcctggctacagggatccccagtgcccctcaccattccttctggtctctcctctgcctcccggaactgttccccaggaccctctcctgggccagcccttcctgcccctccacatcagtggttccgaaccccggatgcctttgggatcagctgggtacactttaaatccttccagcccagagccctcaggcccaagtcacccccgccagctcctgtgggaccccttggatcagccaaccattttatcatcatccatcatgtcccctgtcaccaagggcctctggcatgttctgttgtccccatgcccaccctggcacccctcacccaccaacctgtgcccacgtcctgccttgagcctgtttcccctcctgagtggtatttcctcactccaggtgggcactggggcagctggcagacatggctgtgagcttctgtcccatccagagggaccctcccttccagattacccagtcaagcttgaccccatggtgtcaccgagacggaccaaaagagggtattgaagccacgcagtcccccgagccccactgagctgcaccagctttggagccggagagagcctgggagactgagcactgagtgctaggtcccttcttcccactcttgagggagaaatcagtgtaaccttcccatcctcccactcttgagggccctggggggacacagggcacaaggagggtggcagaagaggtgtgtgcctaggtgcttggcacctagccggggttcatttctgtcctctcaacttggcctcccaaagtgctgggattacaggcatgagatactgtacctggtcttattttttcttttcttaagatacagggtctcaccatctggcccaggctggactcaaactgctgagctcaagtaattcccccacctcagcctccgaagtagctaggactaaaggcatgaaaccaccatgcttggcttgtccaatttcattctacacactttctcggtatttaaacagctgctgttgctcttcattctgtagctctacatcagattcatgctctagtcctgtatatccaaatgatgactagaggctgccggctctgctctttcaaaggcacaatgagcgtagtccatctacaaaactctcccttttccaatccagctttccctcctgcatcacctatctctctacatctggaaccatcggcagctgccttcataaggcacctcggtctggcattcggaaaaccaccctgtcttgccagagcctcttggtcttgggtagcaaaagctgtatgcaatctaaatcaagctttcaatcatgagaaatcacattccttcttttccctttgtaatatactcatgtgttttttttttcctttctcaataagcaaattgtaccaccatcttattctgagatgctcctttttaaaagctgtagatcacattaatggaagtgtttactgctgggaatattttccacgtgcaatgatctgtaaccctctttttcttttttttttgagaccgagtctcgctctgttgcccaggccggagtgcagtgacacaatctctgctcactgcaagctttgcctcctgagttcatgccattctcctgcctcagcctcccaagtagctgggactacaggtgcccgccaccacgcccagctaattttttttttttgagatggagtctcgcttggtcgcccaggctggagtgcagtggtgcaatctcagctcattgcaagctccgcctcctgggttcacgccattctcctgcctcagcctcctgagtagctgggactacaggtgcccgccaccacacctggctaattttttttttttttttttttttgtatttttagcagagatggggtttcaccatgttagccaggatggtcttgatctcctgacctcgtgatccgcctgcctcggcctcccaaagtgctgggattacaggtgtgagccaccacgcccggccatgcccagctaattttttgtattttttagtagagatggggtttcatgatgttagccaggatggtctcgatctcctgacctggtgatcagtccgcctaggcctcccaaagtgctaggattacaggtgtgagccactgcgcccagcggaactgtaactctcttatctcaactagctgacattattacttcacatcctgttcaatttataaattaagagaggtgccatgggctgggcacggtttgttcactgttgtttgaatgacaaactcatctgcctttttaagaggccagtctttgatgaactttaaactttgtaaaactaatgcattgtgcctgtgtataaaccagtggttctccaaatgtgctgtgtggacctctcgggatcccgaagaccccttccagaaggcctaagaggtcataactgttctttttttttttttttgagaccaagttttactcttgttgcccaggctggagtgcaatggtgtgatctcggctcatggcaaccttcgcctcccaggttcaagtgattctcctaccccagcctcccaagtagcagggattacaggcacctgccaccactcctcgctaagttttgtatttttagtagagatgtggtttcaccatgttggccaggctggtcttgaactcctaacctcaggtgatccgcttgcctcggcctcccaaagtgctgggattacaggcctgagccactgtgcctggccaacactgttctgaatcatactaattaaacctgagaaagctgatgaaaaattttaaaaatttgtgaaagtaatacaaagtcattgcctgctttttcattgacacttgccatgattatataaaagcaaaagtgggtacaatggctggtttctcagcataaatcaaggcagtggtaccaattacattagtagtcattctattcttcactgtcccctacaggtaaaaaacatagcctgaatttcttaagaatgtctttgatgaagcagtaaaaattaatgttgttaaatcttgacatgtctctaatattctgaataagtggaaagttaaccagaagcgctttttttgtttgtttttaaagaatccgtgatttaactgtgaactgaaaaatcacttttttcacagaacatcatttttatttaaaagtacaactgggccagcgcagtggctcacgcctgtaaaatcccagcactttgagaggccaaagcaggcagatggcttgagctccttcaggagttcgagaccagcctaggcaacataacgaaaccctgtcactgtcaaacatataagaaaattagcctggcgtggtgccacacatctgtggtcccagctacaaaggagcctgaggtgagaggattgcttgagctgagatcatgccaatgcactccagccaagtgacagagtgaaactcggtctaaaaaaccagttcaactatcattctcaaaaataaatgaagtgagaggttgtcacttcaagggaaatacgtatttgttcccaatgataaaatttaagctttcctgtggactttgacaaacttgttccttctactgtaggcttggcagcttttcaatacttaaaggtgtgttaaagtaagattggtggttaaactgaaagtgatttttgacacaataaaacataaaccaatatattccaagtaactaatgcatgatattataaatgcaagtagtgagcaaaagatccatttactgtgcaagaaagatcaatgagtactgatggaataaatttattaatatgtaaaatgccaccgtaactaatttaagaaaccaccacttgtgaagttttgatttagtgttaacaaatacccacaactgtctgaaaactttaaaaatacaccttctaccaactacatatttgcatgaggttaggtcatcttattgcttctttttttctttttttgagacagagtctctctctgtcacccaggctggggtgcaatggcgagatctcggctcactgcaacctccacctcccaggctcaagcgattctcctgcctcagcctcccaagtaactgggactacaggcatgcaccaccacgcccagccattttttgtactttcagtagaggcgggttttaccatgttggtcgggctggtctcaaactcctgacctcaagtgatccacccacctcggcctcccaaaatgctgggattacaggtgtgaaccactgcgccccaccagcttattgcttttttgtttgtttgtttagacagagtcttgctctgtcacccaggctgcagtgcaatggcaccatctcagctctctgcaacctccgcctcccaagttcaagcggttctcctgcctcagcctccagaataggtgggactacaggtgcgtgccatcatgcccagccaagtttttgtaattttagtagagacggggcttcgctgtgttagccaggatggtctcgatctcctgaccttgtgatccgcccacctcagcctcccaaagtgctgggattacaggcgtgagccaccgtgcccaacctcttattgctgctttaaagcaaattgcaaagaaagctctagagaatccatttgtctcctattaagctcaacatgagagactttaaataatataaatacatgacgcactttttactcaactttttgttgtagaaaagttatttttcaatgaaaaaattctgttaacaatactgttctcaaggaatattttctgttgttataacctgggtcatgggttactactgatatctagttggtagaggccatgaatactgctaaactctctgcaatgcacaagacagtcctcacaacaaagcattatctagcccataatatcaacagtggtaaggctgtgaaatctaaactaaaaatagattttgaaaaaatttcaattgtataattctaccacactaaatatcaatataatcaatataaacacatactctttgagattctcaatcatttaagaattatgagactcttaaggaacaaagaaaatacaaataatttgcttcaatattttagtaggcacaatacagcttatgatgtctagagctgtgacctaacactgagcttgatatcttgcaaagtaattagctagaataacaagacaggtttctaaaaagctcacctttgtgtgatatgatgaggtatctccaaggtcacactgtggaaggaaaaaaaattcacaacaatagatgttaacatttgttaggcctgaagacattttttaaaaggggggcagaggaaactctcctagtggccctgaaattcaaatcttctagttcagaacagtaccataagggcactttgttttcatttctttgttttttacaaaaatatgagaaccaaaatgcaaggaaatatgccgttagaagacgcgtttctgttggtgattacaatatataaataataacagatttccttgttatatgcttttctacccacgaaacctttcgtcccatgcgatttattttatgtatttatttattttttgacccagagtctgtctctcttgctcagactggattgcagtggtgccatcttgactcctcacaacctccaccacccaggttcaagcgattctcatgcctcagcctcccaagaagctgggactacaagtttgtgccactatgcccagataatttttttttggaggggggcagtgggtggagtttcgctcttgttgcccaggctggagtgcaatggtgtgatctcggctcaccacaacctctgcctcccaggttcaagagattctcctgcctcagcctcccaagtggctgggattacaggcatgtgccaccacacccagctaattttgtagagtgaggctcaaaacaactgagggaaggcaaatctcaattctactaataggtctacacaatattagcactttttaaaaagcctgtaacattagcaggtaagatggatatgtctatggtgcttcaagtagttttcatctctgaaataattttaaaatcacagaatttaaagttacatgctggaaaggaccaatgaccttatgtgacatttaattcaacactcattttacagatcagggaaacagaccttaaaactgacttgcccaaggtcccaccaaataggagcagtttctcatcctaaactcaaattaagcagtggctctcaaactttgctgcacattaaaatcacctgagaagctttaatatctgcctcatcttccacgagacattttaatttaattagtattgggtatggctttgggcatcaaggttcttagtaaacgtttcccaggtgatttcaatcagcagcaaagtttggaatgattgagttggggtgaaaatcagaatcttctgggatgcttttcttcacagaaagatgcctcacatccatcccgattttcctaaaaggcttctcagtgcctagagatagagggaaagtggagatgggaagatacatgtgtttgcagacttgtattttgaaaaaaaccttgcataagtgatctcagcgagttccacctatcccactgacaacagtgcactactgattcatgataaaacatttttcaaaatatcttcttgaagccaatttgccctattaatttgttcaataactttatttcgccaatagtgaatacaccaaatgatcatttctcaaacttgctggtggcaaattaaaacttactatactctcaaaagtagacttctaaaaagtagaataatgaggaaaaaagcacgaaatttgtttcagcaaaattaatcttcaaagctgcttttgaattatatgctaacatatcaaaatctttggaactcagaagaagccagggactctagtcaaagtaatttttgtgtatgtgtgctcagagatttaagagacttagctgactacagacatttagtgattactcaataggtcccaaagctcaggacttgagacagagtttgagtccagtttttgttcgaaacacaatttcctctcaactattgttaaaagggagggaggaaagtgacattattatgagtgtaaactttccacttttaattgaagtaaaagttattgacaattgaattagttaaaaaggctagtgcatttgaaacaaaattgtttataagctagttatgtgtacagaatgaaaagttaaattaaagataaagacattaatattctaaattagcactttccaaactgtgttctaaaaatcaagactaataacccaaggagatgagaataatgtacactggacagcccctgtggagctggtggtggtgttggttgttgttccttttaaaataaacttcatctcagggtgctctcaaagcacatctttgtggcccatgaggtgctcatgcacaatgggagaaattcaaatgcagatacactgtggtgccagaagaagaaaagctgttccttcctccaaggataatgtccaaagtagtgcacactgatttaggcctatgatgcattgaaaaactaagtttccacaaaaaacattcaataaagggaacctatccttctcactgtgttcaacattgtctaaaggcataaaggcatcaaaaagatacactgtttctgggattgcttctttgctaactgatttttccttccaccacgacgtctaagattaaaagagaaactgatacttaatattcagaatctggatatcaatatatggttgactccaatttcttaaactgattgctgaaaaggacaaccaaatgactgaaataattttagaataaaggaatctgtccctcggcagcatagttgtactcatgatattattgtcattgtaagataatgctggatggctgtgctgtcatcaaggaatattgtcgaacacaagctgtattgttgactgaaacgcacagtagatacctgaaggggaagggaagtgtaagtcaaacttatgaaagtgtattattttctcagttaaaatgtcaaatgacaaagcactaagatatgtctcacactccatgaactgcctgagtgtggtatcatgtgcactctatagaaaacccattggaggctctcaacttccagagatgatgtttaagatatgggttataaaatgctgcccttaatatggtacctgtcatcaaacctaacaaggattttatgaattaccgttaaaaataatgggaaaagtctgcttcgaggggcgcggtggctcacacctgtaatcctagcactttgggaggtggaggcgggcagatcacgaggtcaagagatcgagaccatcctggctaacatggtgaaaccccgtctctactaaaaatacaaaaaattagccgggcgtggtagcaggcccctgtagtcccagctacttgagaggctgaaacaggagaatggggtgaacccaggaggcggagcttgcagtgagccgagttcgcgccactgcactccaggccggcagacaaagtgagactccgtctcaaaaaaaaaaaaaaaaagaaaagtttaaaataagatttcattttttttctgcagcaataaaaagcagctgagaatttctattaattaattaatttatttatttatttttgagacggagtctcgctctgtcgcccaggctggagtgcagtggcgcgatctcggctcactgcaagctccgcctcccgggttcacgccattctcctgactcagcctcctgagtagctgggactacaggcgcccaccaccatgcccggctaactttttgtatttttagtagagacggggtttcaccgtgttagccaggatggtctcgatctcctcacctcgcgatctgcctgcctcagcctcccaaagtactgggattacaggcgtgagccacggcgcccagcccttctattatttatttactacgataaaatgtaatgtattaaataatcctgctacaagagcattttattgcagtgaatacaagactaatgcatttactaaattactaatcctaaatgtattatttcaggtgatattgttacaaaagaagtgtttcagattcagaggctctgtgtgccagggctgctaggccaccaacaagtgaggaagccataggtttctctagtcctattttcttatgtggaggataaaaagagtatcacttaaatattctctcacaccctgaaaacaaatgacaacttaaaaaatctaactttcacttcatgtttaaataagactgccaagacatgactcaaatgagactctcggagaatactttgcattcacttcaaaacttgatcaattgcattctataaatcatctgacctgcacctagccattttcctgctctacccctgctctctgcctagaatactgcttttctctttccttgcttcagcaagctcgactccatctaccctcttggatctctttgtcggcagccacaccaaaaaatgtatttttatacactaattagttgaattcaccactgcttacaagatgctaattcctgcagagtattccccttgtgagaaagtatgcctctccataagagtaagggagggcccttactcttcctacctccagctgctgagcatagaattttgagtaaatccaaaacttcgacaagtgtttgacaattcagttatcatttggaaggtaagtcttactacatttaattacagcaaaaacactactaacagtttactctttataggtattatttaaggtagtcacaaaatagaaacaaatactctaacgtcaggcagcataaatgagagtatgaaattttacaatatttaacaagaaatggaaggggttacttagtagttttaaggtttaatgacaaaaactagaaaataatcgtacctagtaatttagtaagtcaaaaccaaagccttaccatcaaaggtgcagtacccattggatgcggatgcccacgcactgacttcttctgctgtacctgctgcctctcattttaacccattaaaaatactaaagttgttttccttgtagacatgtttcacctccttggttaggtctattcccaagtattttagtttagtttagtttagttttgcagctatcagaaaaggggttgagttcttggtttgattctaagcttggtcgcttctggggtataacagagctactgatttgtgtacattaattttgtctcctgaaactttgctgaattcatttatcagttctaggagctttttggaggagtctttagggtttcctaggtatatgatcatatcatcatcaaacagcaacagtttgacttcctctttactgatctgcatgccttttattgttttctcttgtgtgattgctctggctaggccttccagtagtatgttgaatacaagtggtgagagtgggcatccttgtcttgttccagttctcggggggaatgctttcaacttttccccctttcagtatcatgttggttgtgggtttgtcatagatggcttttattatattgagctgtgacccttgtatgctgattttgctgagggttttaatcataaaaggatgctgcattttgtcaaatgctttttctgcatctgtttagatgatcatgtgattttttgtttttaattctgtttatgtggtgtatcacatttattgacttgtgtatgttaatccatccctgcatccctggtatgaaacccatttgatcatggtggattatcttttttttttttttgagatggagtctcgctctgttgcccaggctggaatatgcagtgcggtgatcttggctcactgcaacctctgcctccgaggttcaagcgattctcctgcctcagccacctgagtagatgggattacaggtgagtgccaccacacccggctaacttttgtatttttagtagagatgggacttcaccatgttggccaggctggtctcgaactcctgacctcatgatctgtccgcctcagcctcccaaagtgctgggattacaggtgtgagccaccgtgcctggccggattattttttgatatgccgttgggaactacaaaacgttgctgaatgaagtcatggacacaaacaaatggaaagacaccccatgctcatgaatgggtagaatgaatattgtgaaaatgaccatactgccaaaagcaatctacaaattcaatgcaactcccatcaaaataccaccatccttcttcacagaactagaaaaaacaatcctgaaatttatatggaccaaacaagaactggcacagccaaaacaaaactaagcaaaaacaacaaatctggaggcatgacattacctgatttcaaactatactataaggccatagtcgccaaaatagcatggtactgatataaaaataggcacatacaccaatggaacagaatagagaacccagaaataaactcaaatacctatagccaactgattttcaacaaagccacctaaaacataaagtgaagaaggtaaaccctattcaacaaatggtgctgggataattggcaagccacatgcgggagaatgaaactggatcctcaactctcagcttacacaaaaatcaactcaagatggatcaaggacataaatctatgacctgaaaccataaaagttctagaagataacattggaaaaacccatctagacgctggcttaggcaaagacttcatgaccaagaacacaaaagcaaatgcaacagaaacaaataggtgagacttaactaaagagcttctgcacaggaaaaggaacaatcagcagagtatacagacaaccacagagtgggaggaaatcttcacagtctatacatctgacaaagggctattatccagaatctatgaggaactcaaacaaattacaattacaaaaatatggaaccagcccaaatgcccatcaatcaatgagtggataaagaaaccgtgatatacatacatatatatatatatgaggaataccacctcagccataataaggaataaattcatggcattcccagcaacctggatggaagtaagactattattctaagtgaaataactcagcatggaaaaccaaatatcatgttctctttcatacgtgggagctgagctatgaggatgcaaagccataagaatgatacaatggactttggggacttgggggaaaggctgggaggagggtgagggataaaagactacaaattgggttcagcggatactgctcaggtgatgggtgcacctaaatctcacaaatcatcactaaagaacttagtcatgtcaccaaatgccacctgttcccccagaaacctaaggaaataataaataaataaataaagtacagcatttttctcagcaaacataaaataaaacaaagactaaagttcatatttttcactctccttttgggcaggacaaattttagataggtttttaaagaattagtaacttttttcctttttccgagacagggtctccctttgttgcccaggctggagtgcagtggtgcaattatagttaactgcagcctcaaactcctgagctcaagcgatcctctgcctcagcctcctgagtaggtaatacgaaaggcgcatgccaccaggcctggctaattttttatttaacctttttgtagacatgaggtcttgctatgttgaccaggctaaaaatgaacaaatcttaattaacttaaatatttctaacactttgggcattcaggaaaacagctccatctatgttgtgaagtaatgggaagtatatggcagtggataaactttgaatgaaaatattaaacaaggccttaggagaaaagtgtaatatgcttattatagatacattaatttaaaaaattctctggcttaatataattaattatactcaaattagattttgatttaaacacaggtcctaaatttggattaaatataatagattgaccacaaatttatttcgtctccctccggaagcctcattagtcataaaataaaggttacacccatgaccagcacagaaggttgacagagataatttttaataaatgctgagacataaaaagtagataaaggagtggtaaataacacagaaacacaactttggtgcctacagaaagtgactggaacagaagcgagccagtttatcttgcagaactaaaggcaggttgtgaacttacaggcaaatggaactttggaaagtagggtaaaatgtgaaaaaaaaaaaaaagccagcaaggtcagttgcaaatctctaactagagccccaagtccacctgtccttccatctgacaagaaacttagatgtgtgttctctggatatatcaaacctgagaatttctggctcagagataccatggcttaaacctgagatataaagaaaactgtacaccaaaaatggaactccaactttcttcgctaactctgtttttcctttccaggcctgcttttactttccaggcagaaaattgggagatccttctcagaagaaactgaaatgtcttcaataaagatccccagataatacactgaggtctcccaaatgaaaagctagtcaggcttctaaggcctcacactgagtgctatcagttaacagaaatcctgcttccaaataaagcaggccagggaccaccacacattggagggaagcctccaagaaaagagatcaaaacaatagaaaaaaggaattgataggaccagtcaaaatcaggagcaaaactttaaaaaaaaatcttaaaacactctcaaaaaatataaaattcaatagaaatggtagaggataaagtcacagaatatcccagaactagaataaaaagacaaactgaaaaaaatacaaggggaaaaattaaaaatcaatgcaggcatattggtctaagcagcctagcatctgaataacaagactatcagtaaaaaagtaacagagaaaataaaaaaaaattctcaagaagagatagtctgcaggtttagtagcctcaataaaatgaaaagatccccaacaagctgttataaaatttcagaaccttagagagagagattctaaaaagcttccacagataactaaaacctggttgtaaataacgtatcacacactggcaatagattcaagaacaacactgtaataagagcacaactgcaaaatgtcttcagaaccacaacatttagattcaacctagaggtgtactctctatcaaagaggagggattttaacatctccacacaggaaaatgtgttcaagtacaactagagacgataacaggacagaaggaaacacagaatctaggactcaggtgatcccacacaagacagcagttacgtgagataccaaaagactttaaagagttagcccagaaaagcagacattgagcatatctagggaaacccacgctatattgaactaggatgacaaaaggccaaagaaagttgccccccacacaaacataaaaaggaacagatgtgttttcgcagatggaaaatatctttgaaaggcatgtgataaatgctacaatacttgggggaaaacagctgttagaaaacaggcaaatgaatatagtcagaaaattagcttcatgctaaaaaataatggatgtgaaagcaaacagagcacccagaggctacttaacgatatttggatagataaactaatgtaggctaggaaaaaagaagatccaggagaattgcagaagtgctcagatttcagaactgtttcagagacaggatgaaggacatggaatgcagaggcacagtgaaaacaccatatgacttagcagtgaataatatttgcagagtcataatcatgtaaatattactgatttaattaaaaagtgtgctacaattggaagaaacacagggagaaacataagatcatggtgtagcggggaaggtatgcttttacctgctgtgacagaaagtcaatagacagtgctggcaattaacttagctattctatttttgttctttcattaaaaataagattaaatatttaaggcaattttttttttttttttgagacagagtttcgctctgtcgcccaggctggagtgcaatggcgcgatcttggctcactgcaacctccgcctcctgggttcaagtgattctcctgcctcagcctcctgagtagctgagattacaggcatgcaccaccacgcccagctacttttgtatttttagtagatacagaatttcaccatgttggtcagggttgtctcaaactcctgacctcagatgatcagcctgcctcggcctcctaaagtgttgtgattacagacgttaaccaccatgcccagccttaaggcaggtcttttgaaccggactattgaaatttaacttaaatgtcagaaatctttaaaaggtggacacgctaaactaagcacttttctggataaatttaatactcaggaaaatagaagagatttagaaaatccacaaaaagaggtccatgctaccaccaccaggtccacattgtaatttaaagaaatcaagagagacatccttttatgtcaaactatcaatttcttaactatttgagtgtttacttacatggtttgtacagttgcttcttcttatttctacaactaagaataaaaaaaaaaaaactggtcacttctgatacaaataccataaaataaaagtagttgttaacatcttactgattactcctatgaaaaatgagacaaaattccattaaaaaaaaattttcaataacatataatttaaattatctggcatgattaatttcataagtcaaatctaaaaacttagattttcatttagtttactttttgtttctattacatacaaatgaaagaatcctcatgtacaaaagaaaagggcaaaaaaattaggccagatgaaaaatttagctaataaaaagtttaactgttgcatatatgagccatgatccattagtattctctcattctgcatttacacatagcttactttaattatcagactctaagagctaacagttctaaaaactacttcctgaccagacacctatctctagatgcaacagaatccctgtaagcatcttgaaccacacttagtggttatctactaatatgtcactaaaaacaaaacaaaattaaaaaatggtctttacacaactggaaagtaacctatcttaaatttgttttcttttttgagatggagtctcactctgtcacctaggctcgagtgcagtggcgggatctcagcgcactgcaacctctgcctcccaggttcaagaaattcttcagccttagcctctggactagctgggaccacaggcacgtgccaccatgcctagctaattgttttttgtatttttagtagagacagagttacactgtgttagccaggatggtcttgatctcctaacctcgtgatccacccacctcaacctcccaaagagttgggattacaggtgtaagccacagagcctggcctaaattttgatgttaaaataagtatacaaacctaattggacatggtgtctgcagcacaaaaaaatcatttttttttccctaaaaagaggccagaataataaaagccccaagagggacttgggccatgctttgtttcctacactgcctctgcctttgatgctgggagggccttgtaggcaaaagttactaccactgaagagtgagggacatggaatagcttttcttttactgcttccatgctctctaggtgtgagaagcccatggctctggaaggaactgggaaatacaattctgatatgttttggatatgttgcccctccaagtctcatgttaacatgtgacccttaatgttggagatagggcctagtgggaggcgtttgggtaatggcagtgattccttatgaatggcttggtcccatccccatggtaataagcaaattctcattacggtaatttaaaagactgtggtactggccaggtgcggtggctgaagcctgtaatcccagcactttgggaggctgaagcgggtagatcacttgaggtcaggagtttcagaccagcctggccaacatggtgaaaccctgtctctgccaaaaatacagaaattagccaggtgttatggtgcccacctatagtcccaactactcgggaggctgaggcaggagaattgcttgaacctgggagatggaggttgtagtgagccaagatcgtgccattgcactccagcctgggcaacagagtgaaactccatttcaaaaaaaaaaaaaaaaaaagagtgtggtaccttcccccttcccctctctctttcaccgtgtggaaccacctgcttcccctttgccttttatcatgattgtaagtttgctgaggccctcaccagaagcagatgttaaagccatgttggtacagcctgaaaatctttgagccaattaaacctctttttgttataaatcacccagccttaggtatctctttatagtaatgtaaaaaatgaagacaaattctaaccagaaataactgactcaagatgggcaaagtctactcaaactataaaaacaaaggttacaaactcccgtgttttactgtgctgcattacttcgcacactattatagaaccctcacttgtattcttgctgtttaagtcaactggaaaacttggctgtgtatggcttgttggcaaataaatgaggatttaacataacattaagggaaataagcaggagtagggcacgtttaaatttacattacatcgaatgaaaaagttaataacctaaaacttttgagtagcatgaacttggatgtggtaaatgaatgtggtcagaggactgtgtaagaggaggcccaaatcacagattcaatccctgatgataaacaactatgttttttaagttgtttaaatgaaaaccaagctgaagcctaagttctatcattcatctttaaagtgtactttttggagcaagggaaaagggattataaataaagataaatccattaattataaataaagataaatccaagaattataaagagaaatccatgactcctccatcacatcacaaattaattgtgttgataaaaagatggcaaaatgtataaacaaaaaggttacacattttcactaacatcataacaactaaaggaaagtatatcacatattaaaataagacaagtgaacatgtgaaaaggtgaaaaatttaaaccaatatgagtttttctaaatactttctataacctgatcaaacaagagattttattctttctcttggcggaaaaaacaatgtcgtctcaccatctgtttgagagttcctctggaatattgtgtttgcctctggattggcagaagggttaaactccaaagctatatgcatagaggaagaaaagaaaaaaagatgtaatcattgataaaaatttatcaactcatttattcgactgctgcatttaggctatttcactatctctactttgattcttatccattgaaatgaatgtatagacataagatagagccaggcaagatggcacatgcttgtagtcccagctactcaggaggctgagatgggaaaatcacttgaacccaggtcaggaagttgaggccagcatgagtaacacaatgacaccctcctttatttaaaaaaaaaaaaaaaaaaaaagaggtaaattttggctttgagttgtgtaaaatcaactttgcataaaataaatcaagatagcagtaagttttaaaagacagtctattttataggcaaaatataagatgtattctagagtttttaaaatgtttaaaaagtaaattcatcatatctgtcacttccatttcattctgaggacacagaaccttagttctcttgagtagctgtcttccatagtcatgtgatatctctaagttttcatttcttcattagcaatacatagggagaacatacacaggccttatttgtattggaaagggccaagtgagacatacataaactgtgttgtaatcctaaagaatgacaataaagagtcatttttgggctctcatccaacactacccatctactaactggtgtgtaacatccatcaggctttccgaacatcaccaagcagagtataagtttacacaagtacttacatgctttgtgtataaaggtacaatcaattaattcacataatgcatttgtttattctaaagcaatccttaaatatcttgaaatgtgaagatagtacttccaagttacaaagtcacactcataatgagtcttaattatcctacctctttaaaaattaagagcccgaccaaagtttaaatagaagagctataagacatttcctctacagtgatgaaatctctggcatttaaatgaaaccaataagccaactggatttaatatgtttatgatgcaatgttttctattttgaaaatttcagtttttattcaagaaccatattattacccagaattacttttacttagattcatctctttgcaaaattttagaggcaaaccaactaattgttttctcttttctaccggctcccatcccctgcctctgccagcagtgtagagactaaaaaactccaactttctttcctttttttttttgtgagacggagtctcgctctgtcacccaggctggagtgcattggcgtgatctctgctcactgcaacctccacctcctaggtccaagcaattctcctgcctcagccttgtgagtagctggaactacagtcatgcgccactacgcccagctaatttttgtattttcttttttagtagagacagtgtttcactatgttggccaggctggtctcgaactcctgacctcaggtgatccgcctgccacggcctcccaaagtgctgggattacaggcgtgagccaccaagcccagccaaaactgtaactttcttatctttgaacaagatgctattgtcaggaggggaagggacaaagggggagccatggcaacaaacactctaacagggaaggtctgccattttaacctgcaatctttatattacacattaaaagtctacattgacgtttcatgtcttttgaaagttttgaccatgaaccaatccccacctctcttttagaacaaggaggtaaataaagtctgttaagtcaccagaataaatctggagacacattttctgttaaagtaagaattttaaagtaatcagagcctcataggtaaactcctttgagaaaccccaaacacacacacacaaccatttttctgcagccccggctgtgacatttcacacctttcacaattattttaagcattctccttttttctttttccttctgtgttcaaattacagttagaagaaactaagcagcttctatcaaggtgacttaaagcagcccattaagaataccatatagcctctcccgtggcaacctccattctgattttaaataagaaatccccaaatatttgaataggaactgtcctgagatttggctactttaacaaaggaaacaattaggcacttacctggttccttcacttaggtaccatctggataggtacaaagaaaaaataagatgggtactgaaaagttgggatatttgagtttttattgagaaaaggaagagaatagctcaaagaagcctaaacaaagtcccacaggataataaacagagctacagacactgttgtctcaccatctgtttgagagttcctctggaatattgtgcttgcctctggattggcagaaaggttaaactccaaagctatatgtatagagggagaaaagaaaaaagatgtaatcatttataaaaatgtatcaactcatttattcaactgctgcttattcgacaagagccataaataaatggccccatgccagcctgggagaatgagatgagagagcaagaactgggcgattgggaggggaggcgaaaagaaactgactggactcggtggggaaagactaaggggtgggaattcaaggcagagccagcttttgttcctggccagcccccgggaaagctggctacaagcagaaaggagctcgaagtgggggatgcctcaaagggaaccttggggacagcagcagccaaaggcaaaccgagggtagatggcacctatcacctccttaccttcaggcatctcccggtcacgaacgtggtgcatgtggaggtcctcaccaacttcaacagtcacctcagcaggctgtacagcagcagccatgggcgctcctgccatcctgtcctcagctcctgcctcatagatctcagattcagagggacacaccgacccctgctgctggtcaaactcgaggctgacgctagggtgcacacgacaggtcagtatgttccccatggggcgcctctactgtctgccaccacctgtgcctctgctcacagctttggccacgcactcccgctgtcctaggccgaggctatgctgcacttgcagagatggtcttcccgctcctcgcctgcccacctcacagcgcggccccgggcaccagccctggccccggccccggccccggccccggctagggctgcgggccaaggcccgcaccctgctgcctcccctgagttgacttgtctgggagggtgaagaccagccggcttatttaataggttgtgaacccaacaagcgctgagagacacaacaactgcctgaaaagagaacagacggagctccttctccttctgtagtcacctacagactgaagcccactggccccaggtgggagcccaggcatgtggcacacaatgccccaccccacacttcacaatgccctccccgacacctcacagtgccccaccctgcctgccacccctccccaacagctcagaatgcccctgccttggctgccccaccctgtggcttatgatgctgctgctctcctggcccctcgtgcagtgccagtgggactaaggttttcattcatcaccagcttcctgagattttagtcctaagaaaagcacagggtagttcattccttgaagccagcttcctctatgagttctatacaaagcctcagtagagtgggtcccattagcaaccaagttgaacaacttttatttgctgtctgaatatagatacacctgaattgttgactgcttttgtaactaaacactcctctcctgtcttccaacgagtggtcatttttgtccgcaacttgaccacagcaatccctggggccctagctctactctcaataaagagttatggctgtgtgttttgaatgacaccttaggacccatcctgcctccacctccttctccataaaatagaaacctaactggcacctccaagctctgaaatgctgaaacttaccaactcccttttctccccgctatttcttccttccatggcagggactttcaggttttctttcttttactaacaaggcactaagcatgattttctcatacaaaatcgagagccataaagtggcttaccacagtcctatttcaataaagatgaatactcgacatctggcaagtagtgtgtgcctgacagtgtccccactgtgctatgctcatttaaccctcagaaacaatctcatgttacagattttacagaagttgttgagatggagaaggtaagtaacctccccaaggtcacatgactgctaagggtggggccatggtttgatcccaggtagtctgaattccccaattgcttaagcatgagtatcagaaagtatagcagtctgttttcacactgatataaagaaacacctgaggttgggtaatttttaaaggaaagaggtttaattgactcagtttcacatggctggggaggcctcaggaaacttaacaatcatggcagagggggaagtccttcaggaaacttacaatcatggcagaagggcaggtccgacttacatggtggccgcacagagagtgggaacatgtgaaggagcaactgtcaaacatgtataaaaccatcagatctcagctgggcacggtggctcacacttgtaaccctagtactttgggaggccaaggcaggtggatcaactgaggtcaggagtttgagaccagcctagctaatgtagtgaaatcctgtctctactaaaaatacaaaaattagctgggtgtggtggtgcatgcctgtaatcccagctactcaggaggctgaggcaggagaatcaatggaactcaagaggcagagactgcagtgagccaagatcatgccatggcactcctgcctggacaacagagcaagactccatcccaaaaaacaaaacaaaaccctataagatctcatgaggacttactgaatatcacaagaacagcatgaggataactgcccccatgatccaatcacctccccctaggcccctccctcgacacatcaggattatggggattataattcatgatgagatttgggtggggacatggcaaaaccatatcagaaagtaaaggtagaagtcaagcttggatgggaaatgacattgtagattattattattattattattattattattattattattattttgagacgaagttttgctcttgttgcccagtgaaattgtttctctaatttcattttcagattgtgtcttgtagatgtatagaaatacaattgataaatgattctggctattaaccttttatgcttcaaccttgctgaacactatttttttttttttttttttttttttttgagacggagtttcgttcttgttgcccaggctggagtgcaatggcgtgatcttggctcactgcaacctccgcctcccgggctcaagcggttctcctacctcagcctcccaagtagctgggattgcaggcatgcgtcaccatgcccggctaattttgtatttttagtagagacggggtttctccatgttggtcaggcccacctcagcctcccaaagtgctaggactacaggcatgagccatcgtgcccagccagattcgtatatttttaaaagaattttttttactttttattttttttttgagacagagtctcactctgttgcccaggcagtggcacaatcattgctcactgcaacctccacctcctgggtccaagtgattctcattcaagtgcctaagcctcccaagtagctgggattacaggatcccgcccccatgctcagctaatgtttgtatttttagtagagatggggtttcaccatgttgctcaggttgatctcgaactcctgacctcaggtgatccacctgccttggcctcccaaagtgctgggattgcaggcgtgagccaccactcccgaacagaacaacatttttttgatgtggattttaaaatgcctccccttctttcaacattgattaagtcccttctacatgccaggcactgtatgtgtgaaatagtcccaactctcaatgagtgtaggcagatacacaaacaaaggcttaaggaggtcagttttctgagaccatactgctggacagtatatgaacctgggatacaaacccacctctatttgacctcaaatttgatgctggggtggttttaattttattctgggaatttcagtcattcaaccataaaaaggtgaaaagtctctgtcagatgtgcgtgtagtggtctgtataataaagactgaaggaagcaaccaaaccaattaagagactttctctaaaggcagagtaatgctaagggcagtggcagtgacaaaagtggaggaaaaagtctgtgatcatttgggagacagaataggaagtgcttggtcatgagatgtgaaagaagaggggaagtagaaggaaaacagagctgctcaggctctgctggggaagactgggtgtgtagcagtgccttcctcctggccgagaatgtaggaagagaaataggtaaggaggaaaagatagttttttactctcagtgtcacattaaaatggaactctctggtcaaaagttgaatataaatctctgtaggctaagtccatttgtgacatcccaacatatgttttcaaaaataacatacacactaaatcaagccattaagcgtaactggggaaatttcctaaaatttacatgctaaaaaatcaccatttttcatttattactttcatggagcaactttgaatctatggttacagcaggtgaggcaccttgtataaaataaagctaatacatgaaataaaaccatttaaaattctattgttctcagagaatggagaaagcaattgaagccatgggtgtggaggtgactgccttgagaagttgtgtatagtaaggagaactgggaagaaagaagacctggagaatagggtgatttgcacggcattaagtgaagcttgaaaaagtgagcactgagactcaagagacatgtatgaatcagaaatggctgctcctgtgagttgttagaaaggagatgatgccttcttttcatatctataacagtagcacctagcacagtgcctgttcaataggtactcgacatgtattatcccaatgcagagtcaaattttgccaggaaggcaggaaagctacaaattagctatggcaacttagtgattgggcttgggtgtgtgtgtgagcgagctggatgtcaggcagtgggcaaagtagtgaactggaggtgagaaaacaatgacacaaactcagggcttctcttcccaagtatttggctgagaagagagatgtagtattaaagggagatatgtggtaaaggaagccttttatttcaagattcaacaaaagcgtgagtatacttctatgttaaagggaaagagccaatagagaaaacacatttttgaggttagaagagaaggaagaactaatgcagaagggccccaaaaggcacaggtgcgtgcaatccggatcagggacagattagctttggattcctacaaaagcaagaagggagaaaggaccatgtgacactagagatatttctggtaaaggaaaggtttaggaaaatatcttttgatgacctttattttaacataatttttttttttttttttttgagatggagtcttgctctgtcacccaggctggagtgcagtggcacgatctcggctcactgcaacctctgcctcctgggttcataccattctcctgcctcagcctcctgattagctgggactacaggcacccgttaccatgtccagctaattttttgtatttttagtaaagacggggtttcaacgtgttagccaggatggtctccatctcttgacttcgtgatccgccggcctcggcctcccaaagtctgggattacaggcgtgagccactgcacccggctagactttaaaaaaaaaaaaaaatactgtgggaaaaaggatattatgtatagaaaagtctacacttcttgatacaactaactaaaaaaagcctgatacactaaacaaaacccaaataatgtcttccctaaaagtgggtaacttgaaaagcaattcgagcaaaaatcaaggagttcaattataaataagtatatcaacaaagtgaaagatgggtttaatttttcccacaaaaagttaaaagaaataacagcagttttagaggaagaggaaaaaataataagaaaattatatgcagttgcaaaatgtgtgactatttacaaactctaacatataactacaaaacggaccagaagaatcattatcataggaagcaaagggtcatttcaaaaatcagaggagggatgattcatatttaatttaattctgtggaaaacatttaagtaacctttgaggacaaaaataggtgatatgttgaaatgcgggaaaccacagtggaaggaaaaagaattcaagaaagctcagtttcagtaaccagtatctagtaaaatcttcaggacctagaggctacaatctgcattaatagtgtctgaagacctagaaatgtcattaaataccattttggataattcttgtagacttgagatgatgtctatttaaagttacaagacagtgcctgtatttctgtattcataacagaaaacaattggatatggaaaagaaactaacatgctatgccacaatctctaaagaaagattagggaagtttcagcttaaagcaagaataatcacaataaagttttacaaccctttgcaagcatatatgaaaaacttacaaaaagtttgtaatgatcttttcttaagctaagagaatggaaaaaatgagaaaaattaaattataaaatgaaactttggtttagaggtaagaaacatttgatgacagtcaagagatcagggttgtacagtgtattatgtgaatgttgtgactcattggtttcatcttggatatcataacttgacattttgtaaaagtgatttttcatgggagttttttcaggtgccctataaagtcctgtcccatgagaagcgaataatagtcttccatattcttgagatatcttaatgaatagcatcttctacagtcttccattgtttagtccttggagagacactcattagtgactgttaaggtacctgagttattaggtgcctgtagactatgcccagtgatatgtgcattaggtacatgctccctagctgcgttgacactgactgaagctgtgaggtttcacaatgacatgtcagccaaatacatatgctcagatttaccatttatcaagaggtcttcacactatcaattgtgcaattatcattctacacacaggcagcgataaagggagtaaaaaaacacagccatggatcgggagactaaggtacctccagaggagtccagtgggtccagaagccctttggatgttggtcagaggctcctcttgggcagagatcacagcagcagccaacaggtctggtgaaatccttaagagttctcatggacaaagtttgtgaaggcatcttagacaagatcttgtctttgctggttttatgatcctctgcagatgggtctattctcattatctcagccacctttcacttcctatcagttcagttcaggtctctcatgatcccaggcagcagtagttgttatcacgtgagttcattcatatatgtttatctctttggggatggggggacaacttcactgtggacttaattctactggagatgagtgaccccattttaagacaacatgatcacaaattattatcacatatcagcagggcagacaatagctatgacctggggctgaaagcaggtaactccatttattctgcaaacattgtcttgattatggtgccagttgctgtgagggatttcctttccaccacctgtttttcacaaggtttgagtctgaactgctaacattctactgatttctgggtgaagggactgactgcaccatcctagcctgtcagagcattcgccccaatacttccactttaagagttttccaccttgtccagaactacagtccattaatcccctcattttctctcttaagagaataaacaggccaggcgcggtggctcacgcctgtaatcccagcactttgggaggctgaggcgggtggatcatctgaggtcaggagttcgagaccagcttcacttacatagtgaaacctcgtctccactaaaaaaaataatcacaaaaattagccgggcatggtggcaggcacctgtaatcccagctactcgggaggctgaggcaggagaatcccttgaactcgggaggcagaggttgcagtgagccaagactgtgccacagcactccagcctgggcgacagagtgagactccctctcaaaaaaaaaaaaaagagagagagcgagaataaacaacccatgtcaagtacacacccacatccctcttatcccaaataccaaacacacaaaaatccaatctgtctccttctacctaagcaattttagatagtcactttctcataattaccttaagctccctgacttgctgctcgtcctttctctggcaaaatctcatccttggatgagcccgactttgtgtttgctcaatgacaccactcacctgaaccagaaaaaatatcaaaaagtggtcagagatatcatcataaattcaaattacttacacaaaaaaattggccctaaatgtttccagaaatcaataaaagttttgtttctccaatgacatcatttcttcagaaacccaacgtgtataacctattttttctatgttcttctaacatttattcaacttctctcatctgatatcttgccaaatcattcaaagagaaaatatatcccattaggcaagagccgaccatattcccatcacctgagaaaatcatatgcacaggatgcacccacctcacctttctctgcctcatcatgtcagaaaaagtacccctccttttgccacaaggcaaatctgagataaaagatttagatggcctgtaattccagcacttggggagaccaatgcaggcagattatttgagtctaagagttcaaaagaagcctaagcaacttagggaaactgcatctctcaaacaaatacaaaccattagcctagcatggtggtgtggtggcacatgcctgtagtcccagctactcagggtggggagcactgaggtgggaggatcacctgagctggaaggttgtggctgcagtgagccgtgatcacgtcactgcactccagccagggtaacagatattttttaaaggatcttctctgttaaaaataatccaataaacaggtggccatgaggctgaggtggctgccgtgcactcaattcctccttaaataaaccaaaacttgactcagtgtaaataataaaaggaaacttaagcttaaccaatcagaaaccaccaactaacatctaactagagaccttccactgtaatgttccaaatgaggccactgctccacttcacccaatcaagtattttctttttcttccacattcaccatataaaattcttcccccaccctccctaagcctctctgtgggacctctgagctgcttgcagtctggggctgcctagtttatacatttctgaatgctcaaatatattttctaatgtttcaaagtggctctggtgtaggaggttgttggtggagtgacccgagagtatacaggaattgagggcatatgagatctctggactctgcactccattttgctgtacactcaaaactactctaaaataataatatatctttaaaaatctataactagcacgtagcccttttcaagcctccaactggttggagccagttcgattaaagctcagaagaaaaactggttaataagctagttctgacccaactggcaagaagcagcaggaaagacccaggccaggggagcatattgcacatgcatgcaccaggaaactggaggaagcttggaggccctttagcctggtcctgagcccgctgaaactgcagttacaggcacagatgcctggggcaccaatctgaatctgccaacatccaaggccacatgaacacaaatgcgcagtctcctctgcgatcggtagctaaggatgttaggccatgattggactaggatgggagatgaactgagaactctggattctgtaggttgttgttgtctcttcccacccccaagcaacaagtgatgaacacacacacacacacacacacacacacatcctgtagtgactaacaggatctccctccaggggatttgcagaaaggggagcagaaaacatcccaggggcctttcacagctacttccttgagccccctttcagactgctgtctagacctgtcgcagcccaaacatcatcaccctgatatgcagaagctggcatccttacctgaaattcaacaccaagaaatgatctcttctactcaacactgatagaaatacctctaagcaacgtcctcattggcaggggtggagtgggggagtttcttaaaaagggaggcctctgcctaccacctagagaacctggaaatttccatctgtgccacaaagtccaaatcactagccactgccccagtgtatggcagattagaacatctctccattagatctgggtttctattccattgagtgaaatggcttttctattacaggaacagaataagggttcaaaagggtcttacaactgaactccagtgtacagtctgcacagacactaggcttgtgcaaatatgacacagcgaggccccaggacccttaagccagctgaatgtactgagtttcaggaaacagtgagatacattcagcaaaacagtgggcttcatgctgaaagaagtcactccaagtaaacacacatcacacacacacacacacacacacacacacacacatacacacacccgcagacaccctagtggccaataggtcctctcaccaaaaacctgtgatcaggagagcagaaagcctcccaggggtccatcactgccctttctggagccccttatcagatggccagccccaggacagcactgtctgatcctggtccagtccaaaccgccatcaccctgtgatgtgggagctggccacttcaccagaacctctgtgtcagaaaaatttctcttccttttaaaatgatgagggggaaccttcagacagtgtctgattagggtgggtggagagaggggcttcctagaaagtcaggcagggcagggctgaagccctctgggttaactgtgtgcttttgatatgaagtcaggtaagactggacaggtgggcgtgttagtgaggggatggtgtagggtgtgctgaagaactccacttgagctctgcacaccagggaaaatgaccataaaacatcccatcttcactgctcagagaaggctagatctgctgtgagctagaaagccatgtgggggcagctgatgagtcatcaaatgggagaaatctgagagccatgtgttccacaggcctctggtccttgttcaggcagcagggcactgtgacatgtggctccttggccccttccagccaccaccttgattgcatgctgcagggaaagagactgaagaccaagaatggggtcttgctcaccatgggatgatggctcagtacagagctgagctatgtatggcccaagaggcagaatgtggggatgacccaggctgagctgggggatccaactgaacatgcacttgctaagaagctgtgggctatgatgccttgggaccccagtctgggtctagaattgtagcaaaacaggctactggtaaaagttcttgggaagccaactcacttttgctgtcatccatgggcaaacaaaccaagccccaccacttcccactccctctgaaagcctcctgcccctctgatcgaccacaccacaatggtgtcactctgtaaggcacaggtagacaaggcatccagccatgaacactccagggcgcacacatgtccagaatacactggttcttgttgagactccactcttccaactcagacagaagctccccaatctcctcagccactcccaacaactggaggtctgaaaactttcatgcatgccgctatggtctaaaccactcgtggcggttttcattttcattttcctgataatcagtgatgctgagcacctttccataatgccttttcaccaactggatgccttctatggctaaatgtctattcaaatccattgcccatttacaaatctgcttttttgtgggcttctttttttctctttttttttcctatttatttatacaagttccttaggtattttggatattttttaaaatgattttcaattccactgcccagttataattttttttttttttttttttttgagacggagttttgctgttattgcccaggctagagtgcaatggtgcgatcttggctcacagcaacctccacctcccagagtcaggcaattctcctgcctcagcctcctgagtagctgggattacaggcatgtgccaccatgcccggctaatttttgtatttttagtagagatgggttttttccatgttggtcaggctggtctcaaactcccagtctcaggtgatccatccacctcggcctcccaaagtgctgggattacaggcgtgagccactgtgcctggccaattatcccttttagtgtttttttggggggttgggggaagaacagagactcactctgtcacctaggctggagtgcactggtatgatctcggctcactgcagcctccgcctcccaggttccagcgattctccggactcagtctcccgggtagctaagatcatgggcacgcaacacatgcccagctaatttttgtatttttagtagagacagggtttcaccatgttggccaggctgttctcaaactcctgacctcaggtgatccgcccacctcggtctcccaaagtgttgggattacaggcgggagccaccactcccggccccattttgtgttttaacatcagtcgacactcgtattttaaaataacaacaatgaatggcggtaccttagaacaaaggaattatagatctttctcttgtcctagtgcagacattttgtctataaaatgttattcacagatgaattcatgagaacattactgtgaattttacatccatatacaagtgtatgctcattcatgaatatttcaataaaataaaactaatagcaaaaaagaattccagagttgaagcagtttcaggaaaaaggagttggcagtatgaagtaaaatagcaaaaaaaatgtttttttaaatgggtatatttgtgtctacaacttttttttaattatagcattagacaatgtgtatatatatacgtatataaagcaatggaagtagcattgttttcatactagtctagaatattaaaatatatgtaatatgtgatcagcaaaataatggccccccaaagatgtccacagattcctagaaccttacatgaaaacggtacatcatgcatgtgattcaggtaaagaccttgacatgaggagactaccctggtgctatggaatgaatgttgtgttccgtcaatgttcatgtgttaaaatcctaaccctcaaggtgatggtattaggaggttaagccttacgggagactctgccctcatgactgggattagtaccttattaaaggcacaagggagcttgtttgttcctctcaccatgcgaagacacagcaaggaggaagcctctatgagaaagcaggccttcaccagacaccaagactgccagcaccttgatcttgcacttctcagcctccaggactgtgagaaacaaagttctgttatttataagctacctggtctaatgcatttccttgtagcagcctgtacggattcggacagtgggctcatgtggatgatgacggtgtctccattcaggactaagtaagcacatgagtccttaacagtggaagagaagggggaaggaaagagccacagagacatgtggccatagaagaagggcccatgggatgcaaggttgctaatggtgagagtggagaagagcccaatgccaaaaaatgcaggcagactccagaatgtggaaaaggcgagaaaaaagatcccctagagcctctagagatgaaggtagcctttccaccacctagattttagcccagtgagatccacatcacactctgacatacaggagtgtaataaatttgttttatgccctgacatactggtagtttgttgtagcagcaatggactagtaatatataaatatatacacacacacacacacacacacacacacaaacactacccccccaccacacacaacataactatctatatatatcctgcccttcaaaactgaatcagataaactacacattagcattaacttagctgggtgtggtggcacatgcctgtagtcccagctacacaggacgctgagagggaggatcacttgagcccaggagtttaagatcagcctgggcaaacacactgaggccacatttcaaaaacaaacaaacaaaaaacacaacaaatctttgattaagctcatttcccaaatttgaagaggaaacaattattagataaagaggagaaaagagaaaggtagagctgctgacttctgtggtggaagcacagacacaggcccaaacatactcctgtcctcctggctttcctgtcccttctcataagggacacaggaacctctcaaactgaaccatggatcacagaaccatactcagaacgcaatacagttttgtctacaattttttatatatctgtgtccctgtctctgcctcccattcccaactcccttactcttgttagaaaaaaatggctattatcaaatatgagtacatccttatatactaatgccaactgatcaccagctggttttcttcttttacaaagtcataaatatttaggctttaacacatcttccaagcaatagaatgttattttccagttcattaacacaaattctatatctaaaatgaagacttcacaagttgatttaaataacatattaacgaaaatcgactggccatggttcaaactgacattttaattaaatgtgatgataggttgagcaacctagcagtactctaaaatgacttttggttatggctttttccatattatgtttaggctgaggcatccctaaatgattcaattgtaattccccttcttaaacatgagatttatctttacaaaataatttattttcttaaaattgcaagttaattctatagttcatgcatacataatctcagtagatatcagctgtatgtgtacacacatacatataggtatttgtatatacacacattacataattaaaaaaaaaacttattagcagggtacaaccacgaagacaaagaggctttgtgtaatgtgatggaaacacaattgcaggacaaacaacaggctgctgtgagggctgtatttaccctttctgatgtaagacttggaaaaacatggatactggatatttaatccccataacagaaaatttagggtgcagacaacttcccacaatttttacagacaatgtcaatagaaatgcattcaatgcagggaatacacagtgtgacagtatacaaaaataagcaggttgatggtttagatttatgagacaagagaaagaaatagtagatgatgtcataattctccttttatggagttatgaaagttcttcattttatataaggtcaggtgctttcaaatgtcaatgagaaaaatatttaaaggaagaatcaaatctaagatgtagagagatctttataaacgtgaacttcaggccaggcacggtggctcatacctgtaatcccagcattttgggaggcctaggtgggccgatcacgaggtcaggggatcaagaccatcctggcccacatggtgaaaccccgtatctactaaaatacaaaaaatcagccaggagtggtgacgtgtgcctgtagtcccagctactcaggaggctgaggcaggagaatcgcttgaacccaggaggcagaggttgcagtgagccgagatagcgctactgcactccagtctggtgacagagcaagactccatctcaaaaaaaaaaaacaactttttttcatgctgagaagatataatcatcaacacattcttgagcacaactatgcacacaggcacttccgcattcacaagccatgctgtgtgcacacactgatgcccctagattccttttttgaagagatggtctcttggtgtgtcacccaggctggagaggagtgttaggatcatagctcactgcagcctcaaactcctgggttcaagtgatcctcctacctcaggctcctgagtagcctgaactataggaatgagccaccatgcccagccaatgttttcattttattgtagagatgaaatcttgctatgttccccaggtgggtcttgaactcttggcctcaaggaatcctcctgccttgccctcccaacatgctgagattacaggtgtgaaccattgtgcccagccaccggattctttattaagaagaaaacttgtttgctgacatgtaggcaatgaattgatgaatagtagttcataaattactaatttacaagtcaatataaatgagttgagtaaacacaaaataacagcataaattaatgaacagtttacgacctcaagtttctttttttcctttaaaacattgctctgacagagactactacttgtccattccatggaaaagtcagaggtggttaaaatgtcagaggtacacttattaacaccttgctgccttttgtgtagcttcctctcagtacttcaccagttgggattgacacacctctccagctgggttcaggagccagacaggagcacacagaacagggaatccaaagccatctctgacaccaaaagcaatgaaaacaaaaataaccaaacatattatcaagaaatgaacaagagatcgatatcaagtacagcaaaaagagaagaaatcacttaatctgccaggctttcattctgacaaaataatttacaacacgcatgtctctatctgacatgtgtgaatagaaaaagaagaggtgacaatagagtagaggattcgtcttccaattgtctctgatctatccaacctttgttacacatcagagagttctccaatttataaataaacaacagagatatgtggcaaccaggacacagagacatactgagagtactgctcagctctctgcctaggcctgattctgatgatccctgacaatgagcactgtgaaatttacagcaaatcagtacacatacacacaaacacacaaaagagatacttcatgggcaaaaagcaccaaagatataaaataaaatgcctgaaagaccataaaacaacttctgatgaaatgctgttttcattttgcagtagtaaaatattcaccaccaaatctacaattagcttaaaaattacaataagtacagtacttttggatcccatctccaattcacaccttatcaacatgtaataatcacactgcatctacaacaaagctggatggactttatgtgctgaatacaacttgcacactaagaaggaaatttgttgaaataatgagaatccaaaatttgtatgccatgctctacttcacaagttaaaagaaaatacaatcatttctatttttaaaatgcattgaaataaaatacagaaaatacagtattctaataccagttaacattaagagaatatatctctaaaccaaagatcttggatcttctagaaacaaaatcagctggtatatatttggataagaaaaaaaaattaagagatcaagaaaggagagaagacgttcgcacagaatcatctccaaaaatggctttctgacgcattcgaccagttttcaagtctatttgtttttcctcctttggcatcaacagcctatatcaccaaggatatgcaaaataattcaatttgtacattaatcagctaatctagaagtggcaatatagtcaatgaaaatacaaagaaacagaaaatgtcaatgaattgcttaagatgtttaagatgacatagcgtagggaaaaaatgatctgataaacaccggaagagttaataaggaaactgaggcatggttccctaacaccacacttcaaaagaacttatagagagaataaaggaataacccttaaaaaaaaaaatctaattttagaaaaaaattgctcaaaagggaagttagggttttatagatcttctggaaagctgattaatttctaagctaaaaaaactatatgaagctttttaacgtagcacaatagataaaagtatgaaaacataaattagaaaaaactaaaaatcataccataagggatggataagttagaatacaggaataacaggccaggcatagtggctcacatatgtaatcccaggattttgggaggccaagtcgggaggattgcttgagcccaggagttcgagaccagcctaggcaacatagtgagaactcgtccctagaacagaacaaaaaaaattagccgggagtggcggtgcactcctgtagtcctagctacttgcggggctgaagcaggaggatcacttgagcctgggagttcaaggctgcagtgagccaagatcacgccactgcactccagcctgggagacaaagtgagaccttatctcaaaacaaaaacaaaaacaaaaacaaagaaaccacaataacaaaaaaacactggtaacaataaaatcatgattacataaagactgtatagaaaaaaaatcctcagaatatagaaataaaattacgtattttacctgtagctatattagaagagagtattcttgtagacaaggatgtctagaaggatacgcaaaaatgaaaacagctaataacactcattatgtcaggcactgtggtaggtagtttatgcacattgtaacaaattatatactacactatctcaaaattttcagataaattttactggaagtcataaatcaatacaacaaaatcagtgttttgcaaacatccactaagcataaaggtatacaaattcccaacccagactgaaaaataattcacataagccacacattagtggaaacctacccatgggagataatacaacataatctaaataaaactttcagagacaaggcatgtggcttctggacagccacaaactccctgactctgctctagtgtttcggccatcaaaagaaagccaagtggcctcaggtctctgaaaaaccaaaaaagcaacctatggaagatggcgtggtatttgaggaatatttgaagtctgttgaaaaatgcatcctgtatttttttcaagataagactcccttgtaatgtcaggtaagtgaagagccctcagagacacatgcacacacaaagaaaaacaaaacgacatagaatgaatcccaccaaaatgtgttatgatggcagaattatgggtgatatgatcttctgtaatatatctttttattaaaaatagaaaaaaagcagacttacccttgattatctatagcctctgacccaagtggtttggaattggaaagcagcatcactcgacttgaagccatcttggcatcaatggtggagtaggtggagatgagactctggaccagctcatgggtgagccccaccttgtcctatcaaggccaccaagaaagggcacgtgaggaaagcacaaagatcctggagagacactggtttcactcagtttctcaaaattatcttagacacatttcctgagaacctttcttaatgccgcaaacaccagagaagaaaatccttataacaaagcttgaaatggatccccatctccattaaacttttccaaagctcagtgagtatataacctgataacctaaacacctagctagaaaaacctcagttccagtgctacaacagtgctagcttttctaacatttttaagtaaccctgcttttaacccaataaaattcaactacagaactaagaaataaatattggaaatccactttaaaacaatgaggagaccactgtgattgagaaaaagaaaaagacaaacgagagctggaaagcacactgattttgtagaaacggaaataagccgtgcaggtgccacactggcagcagtgcccgcgctggggccacggatcaaggaggcatggaggacaggactcttctgcttggtacaatgaaaaaatggtattatttttattctacatattgacaatatgcatttgggcctttattataagtacaagagaaaaatcttcaataaataaaagctgagtacattactttttttgattaagaaatagattaggaaagaataatgagagttcagagcaaagactcctgcctcactgatgcctgaaaaccgtggctgccaccaaggtcaacacagacagcgtctttgtcatacagcacaccctcaactccagaaacaggcgcataaaccagctgctccttcttatttaaacagcacttcttttgttattcaggaagaacacaagggtctgggaggaaactgatgtcactcatggcaaaatgttctacccctggaagacaggacccaaaaagccagcttcaactgacaagaagtcagtaagtatctactgttgactggggggttaaaaacgatccacagtccaagggcttaacccatgaccctaaagaagggcattgtgccacactggaacagtgaccctctagctacaagaggtcagagaagagggattcggtaacacctttgcaggcctacacatagctggcttacttttaaaacctccagcaaggccatcttcccttgtttggtcatttttcacttttcctgagaaatgaagccatcccaagaatcctatgtgcaattctcgtatgttctacagcaagagaatacctggcatgtgaatttggcttttatttttcaagtgtgctcctcttaaataaccataaagtgacacctgcaggtcacatttgatgtttgtttggatatcctccgggtttgtcaaatcttccatcctagaaaaataaactcaatcatacagcagaaatgaatgccaaagttcctatacctcctttcatgtgtcaatgactcatcacactcttgtccattaagcacatcacttaggaactagaaaatgcagaaataaggaagcaccgttcaccatccagaagaggaaaaggggcaggcacacaactgtgtctctaggctgaaagtgacattcattccataagacaccagatgggagatggcgtccacctggggtcagggaagagtgaagaacacattcagaaaatccatttctcgaagagggtgagcctgtgctctgggatttgtactgtggcttggattctggcaggtggaaaaagggtattccaggctgagaaaatcacagcacaaagaagagcacaaaggaaggaaactgaaggcatgcacgaaggactccagcacccgggcacgaaggcagcatcactgaaaactgaggctgaacgtaggatggggccacatcctgtagtcttaaatgcttccaagtcctcccattttcctaaacatctcataattaatttactcccaaaggcacagcatctttgagcaatgatataagtagacattttccatcaactacacttctacccccactattcaaataggcacaaaataaatcctatcactgttctttttctagcctttttagctttgaaatatatggcccaggaagaaaaagtttacaatcaccttttaactgtctgccaggatataagggtgaaaagtttgccatgagaggcctaaacttcataactgtaataaaatggcccagattgtggatttcttggttttgatattctccatgcaccattccagaaaggtagaacagtttggcaacctaaacattaaaggaaaattaaaaattaaatttcaattaaattctcgtcaatactgcaacaaaataaaagctctaaacaagaagcaatcctaagaagggagacttccagcaaagccactgtcctgaggcttccagagccttgctggattctttcaggacttattagaaccacacagaggcagactgctctgcaaccaagccggggcatccatctaagtatggtgaggagagggaggtgaggcctctgagcacagaaacggttctgtggccgatggaccacagcagtatggaaaggaaggggcagtgcctggtcctgtaactgggagaaacttctgatgtactctattaagtcccgactccaaaacacccagacattgcctggtgcagcaggtacggagacaaatgagatacaccaagaggcccagaataaccactctcttgagggaaaccttccagagactgggaacacatacacaaagggaattcaggaggcaattcctagagagacgtttagtaatgtctcttcagtctttttgtttgtttgtttgtttgagatggagtctcactctgtcacccaggctggagtgcagtggtgcactctcagctcactccaccctctgcctcccagctttgagcaattctcacgtctcagcctccctaatagctgggattacagatgcatgccaccacacccgactaatttttgccttttgagtagagacagggtttggccatattgccctgagctcaaaactcctggcctcaagtgatccacctgactctgcctcccaaagtgctgggattacaggcgtgagccactgtgcctggcctctttagtctgtttttaaaggattatactgttagtttctaacaattatttctcttcctacctggtaaacttctgtccagaacctgtgttttaatcacttctttgtcttcttcagttgcttgttatgcttgaaggagtcgaggtgggtgagaactcccagaattttaggaaagccatgtgcttgacagatgtttagaaactcaaacatttccatttcaaacccaaagctggcatctataagcatcagtacctacaagcacaacacattatttctcgaagaaactaccaaaacagaccacctacactaggggttggcaactggcccacgggccaaatccagcccatcacctgtgtttgtaactaaagttttattggaacatagccacattaattcatttacatattgtctatggccgcctgtgcactacaactgcagagctaagtagctgcagaagatatgatccacaaagctgaaaatattcactatctggccctcaacagaaaagtcccactccagactaaatcaaatgactacacaggcatcacccagacagagaaaccaccaccctctgacttgctctaaaaggcaaccataagacaaggccactaggatataaacatccattttaagaattctaatgcatgagaagtaactcagaaaaggctgggtctaacctggcccttacctaagaaatcctaatttaaagaaatgaagttttctgtaatgtatttttaagccaaataacaggtctctgacatccaaagaatgggaagaaagtgataatcaatgaaatatattaaatacgtacagaaaaccaacctcttctttcaatctcctcacagaaaaaaaaaaaaaaaaaatctgtttttttgctgggaagtatacaatggaaacctctaacttgtatgttaatttgtataactcaattgctcagaaatatttgaaatagctaccagtttagaattaagtaaaaaaacagaaagattatgatgaatggtagtctataagaaaatataagcagataagaccaatttttttttttttttttttttttgagacagagtctcgctctgttgcccaggctggagtgcagtggcttgatctcggctcagcgcaagctccgccccccggattcatgccattcttctgcctcagcctcctgagtagctgggactacaggcacccaccaccacacccggctagtttttttgtatttttttagtagagacggggtttcacagtgttcaccaggatggtctcgatctcctgaccccgtgatctgcctgccttggcctccgaagtgctgggattacaggcgtgagccaccgcacctggccaagaccaatttttaaaatttaagacacttcaaagatgcaaaataatttcagaactgattcctggaaacttgtaattttaatattaaagatagttctgtttgtatctttccatggataactaaaaataacacaaaatggaaacagaaatgcccatccttgattaaactaggaaacattcaaaacccaaaaccacagaatatatgaagttgggcttgtaggaaagcacagctgccactgcagaccaaggcagcaagcagagctctccagcaacactggaccagctcaaagaacaggtggaatatcctcacaccacatctgatgccagagtgccaagggacaagcagctggttgtagggtcaggaataaaagggagcaaacagtccctcagctgccaatctttgccatctaagccagtgtcactcccctaatccacacacgcacgtacacacccaaatccacgtattgtgtgtgcctctgctgtactcaggaggctttgacaacccagagcagagcaatcaacataagctagactaaataaattatggtgcatccacagaatggaatgttatattaaaaagaaggaggcagagctacagtacttactgattatataccttcaagtatattacatgaaaagagcaaagcatagaacagtgtataaaataagctaccgtttgtgtttttaaagggtggcatgtgtgtttatatgtatctggaaggatatacatatacatatacatatatataaaggtctgcagggacctgagagaccagaggttacagcaaggaaagagaaaatgcgcattgtgtgtaccgtgcattacagttagagtgctttaccaaatgtgtgtgctccttttgaaaatcttaagatttacataggcatctctctcaatgatggttaagaggctgggaaggggagcagggagggagggacaaagagggaaaggttaacaggcacaaaaacacagttagatagaataaattctagtgtccaacagcacaatagggtgactataatttattatataattcagaataactaaaagaatgaaattaaaatgttcctaacacaaataaatgataaatgtttgaagtgacagatctctgaattaccctgatttgatcatcacacattgtatgcttctatcaaaatactacatgtaccccataaatatgtacaactattatgtatccataataactaaaaataaaaaaatgtaaatgcatctcttaatatgtatgtatttaaaattagaaacttgctacattttaaataaaagagaaacaaatgacttctatgaactattcaatcatttcaagtatacaagtttagtaatcgttacacaactttacattaattacacttatttttactaatagtagcattacatgttcaaaatttgaatgttatttagttttctgacattacaatggcacaactttaaaatctgtattactttttcctttatattttaggagtcttcctaggccaaagtataaaatctgtagctctagaaaaaactaaataaaaatgaaaaaaacaaggtatctgtcaccccacacttcctaatcaatatggcttatttttttgctaattttttttttttttgagacagaatttcactcttgttgcccaggctagagtgcaatggcgtgatctcgcctcaccgcaacctccatctcctgggttgaagcgattctcctgcctcagcctcctaagtaactgggattacaggcatgcaccacctcacccggctaattttgtatttttagtagagacggggtttctgcatgttggtcaggctggtctcaaactcccgacctcaggtgattcgcccactacggtctcccaaagtgctgggattacaggcatgagccactgtgcctggcctttttttttttttttttttttgccaatgtaaaagatagttcatagaatatcagaaatagtgaacattatcatttccataaatgcaagagcatgtacattttccacacgctgagtactgcctgaattttctattgataaactctgaccacttcttcaggcaattcatgtacttactttagcattatcattaaggatgaaggttctagaaccatcaggaacaagggtcccatcttcacacaagttacttaactgctgggaggctctatttcatcttatgtaaactatagataatacctactcacctcaagggtgtatgtaagctaaatttgtagaaagcagttagcacagtgccaggaagggtccaagaagaaatggtacttactatgatatatttgtacatatatatgtatgcatgtaaatgagctcttattagctgtgttcattaaaggttttctccgtcctgtgatctgcttttagattttggaacacatttcattgtgcacattccatttgtattattaatatgacaacatttattactattattattatcatcatcaattcaatcacatctactatatccctgataatgaccatgatccttttaataatcacaaaactctcttcccttcatcacggggtaaataacctatcacaatgctgtaagtctccatcagcaccccaggctgcccctgctcacttaccagatctgctactttagccagatcaatcatcatgttaatgtcacacccacattcaataatggtgagtctgcgctttttacctataagtgaaaagatgaaaattttactttaaaaagaccctgaaaaaactctaaccatcaactcttaattttcattttttaactgcatccagtaaaacaccacatacgtttacaggagtgtaccagaagttcatttttataggcaaaaactggtaaaataaattccatcctgtttttcttcctgtgttctaaatttagataatatcaaaagcctacccagatgaataaaagtgctcaaaacagggaaaattctgactagacaggctccacgataaccatgatcttgctgttcagctgcaggccaatgtcttcacctctatcaaaatttcctgtattcccactatcgctaaaaacatcctcaaacataatgcaacagaatatttacaatgataattatttctaaattaaggtaataagaaaatgatcaagaaaatattggctgggcacagtggctcatgcctgtagtcctggcaccttgggagaccagggcaggtggatcccttgagcccaggagttttgagactagcctgggccacatggggaaatcccatctctacaaaaacataaaaattaaaaaaaaggaaaaaaaagaaaaattagccaggcatggtggcatacactactcacaggaggctaaggtaggaggattgcttgagcctgggaggttgaggctgcagtgagctgtaatcacaccactgcattccagcctgtgccacagagcaagactctgtctcaaaaaaaggaaaataaaatatggatgcgccaaagataaagaaaagcctcaatccaactatattactgcaataataagagatttcagagtgtacattgccattctaccactggatgtttgtttcatcttccctcaaacttggaaaggtcaccatctcccaaagcagacaaattctcataggaaaaagagaaaacgcgcacttccaccagcatgtggcttcataagggcaagcatgtgcacctggcacataggaggtacgtgctgtctgttaaatggtgtgttcgcagtgaccaggcctgtcaggcccttccaaggaacatgcttggcaaagccatagagcagtcaggataaggtatgtatcacatccttatctctgggaacttatccttttatgaagttatagctaacttagtaaaagtaagagagaggtaacatgatatgacaatatttaacatgttccactcaagaaaacaacaaacacacgcatgtccctcagatgacaacagccacgccaagtctgtgtctgtggcggcatctcctacctgacacgatcgtcacagggcctctgatctcggtgaacttctgccaggtgaagttccgaatgaggcattatatcaaagtgctctttccaactttggaggccccgtcaccactaccgctattggtggcggctctagtggagttccatcaaccactggaatatgatgcttttgtgtcttcaaatccagagtcctatttatttaaaaaagaaaaaaaaagtaaactcacttttaaaatagagtaaaaggtatcaaccttataagtagacttttttttagtataattacagatatgagtactttagtatattttatagagagtacaacagacaatataaaaatataagtaacttgtcaattattaacttctgacccctatccaaatcaattgctgttcaataaagatgtaacaagatgacttcaatagtatagagttgaaaattaaacactccttaaatctgactgttttatgagtgatttttatagttttttaaaaaccaaaaggtaaatactgaggcagcgcatcataacagataagagcagaggttctggagttaaatttggctctccgacttactggttgtatgattggaggtaacttgttttcttgacctcagttttcttgtccataaaatgagggcaagaatgattcctactctggtaaggctgctggaaggatttagttgaataacgtttaaagtacactgctaagaatatcataaggactcactaaataaaactatgttagtattacatattgtaatttttgtattttatattacaactttgtaaaacatatccagagggaaaaagcacacttatcaccatagaaacagtttaaagtttaggaagaatcaaattctataaattcttgtatcttgggcaagaaacaccaaccagtgtgcagatgctggaggcaaggcagcttctatggcaagtcttctcacgttttagtaaaagccacacagcatgcatctccatgtcctttggagctggactagacttgtgaatccaaatgtcacctgtgagaggctcctaactatttaaaaagattcaatggaagaaccatcagactgtagctaaacacacctgtgaaaggatcgagacatccacacagcagactgaactgcaaaagcattggcatttctcttctgggcattttcttcgtctcctagctggagatcctgcagatgccacttctttttctttgcagctttgggtccactgtttttctttctgtgtttcttctggtccttagtctccatagtggctatttaccaataacaagtaactctaacctacaaggaagaaggttggggtaaggaggtgggagaagcattttacaatccaggcaatacccagggaaaaacattaaatttcatttatttctttatgaagacatgatgtatttgttcactgaacaagggtagaaactgcttaaccatccccaatttcatttctctctgttatgctataaattagatgagttacctctgctaaggttacattctatggttaagttactttttactcgtctcaagtgtcaacatcaccagtacctatttctgcaaggatggaaatattctatatctgtacttttcagccatttagccattagccacatgtggttacttaaaatgtacttcagagaaactgaaaaaatgaattcttaattaatttcattctaactctaaatagtcacatgtggctaccatactggacagctcagacctagacatcgactggactaacgaagtggtttcctaacttaaactaaaacttaaatttcaataaaaaatttaaaacgtttttatgaacttccaataggatcgcagtattacttttagtacctgttgactctaaaacttctaaattacagctcatctacatacatttgaaaaatagcaatatctgtatgtgtgagatatgactggttctagatgatgcctggaggccccatggacttacagagacccttccagtgatttctgaggtacctgggaatctgtggccaataaattggtagtcactgaatctgtgagtttttttggaatatcgggctgcataaaatctgacagcttgattgagaaaaagcggggcagggtgccatttcattcagttaaggtcctgtattcattccgtttaataaacgtttgtgtctgtctatgatgtgctagccactgtgccagaaaatggatatagctatggtctgattgacagaggaaatccaaactagtatcttccgtgccatgcaataagagctacattgcaaggctgcagagggtgctactggagcacagaagtgagtcaaaggcttcccacagacacacacacgagcggaaacagaaagtctttatatatcaccatatgtcaaggaacactggccgggagttaggagagctgggcactaggaacgctttgaaactgaatagctgtgtgatttcagaggttatattgcttgtctactatattttactgccgaacttgtactgtttctctcccttttcttcttggtgggaaaagcacaatttggggtcaacagattcggctcaggtctaagtcgcctgccgggaccacgtcgccaggaaacgacgtctccccgacaccttccctcccagtccgggctctctgcagggattcatcccgtcactctcccaacgaccctcgggcacacctcaggcagatgcgaaatatgccgctcctggggagcaaagatgacccggaggaccgggggagtaccttcccacgcgcacgactcgcgatcttcccagtgccccagagccacggacccaaccgccgcctaccccagcccgcggcacctaacctgttcacaactgcgactccttaggtccgcttggacaccgccggaaacggaaattcaccctcgcgccgactcgccggaggtaaacaaaaaggcagaaaaaaagggaccgccgcctggacgacttgcaggggacagctggaagaaagactcgtcaacggccgagtgctggcgccggcgccgtctgcgcagtgcgttccaccgggtccgcgtccctcccgattcagccccaccccgccctcggaatccgctgcctcagctcctgctgtggcactccccagcagcttgcacctcgctcgcggagtccttgctgaaggccagggcagctgtgcggcctggcgcgggttacttgatgccgtgcaaaagccaggagacacatttggttctggccgccccggagtcaccgtgcccggggcgaatggactatggctggattgggagaccacttcctcctctgtaaagatgacagacgagggagatctcacgttctgggggtgccctatagccctcttttggccagaagcggtggatcacgcctgtaatcccagccctttgggaggccgaggtaggaggattgcttgagcccaggagttcaagaccaatctgggcaacatagggaggctacgtctctcaaaaaataaataaatacataaataaataaaaataaagccagcgtcgtggcggggcgcctgtggtccctgtggtcccagctactctggaggctgaggcgggacgatcgcttgagcctgggaggcagaagttgtagtgagctgagatcgagccactgcactccagcctgggcgacagagcaagacactgtctcaaagaaaaataaataaataaaataaggccctctttttccgggaccaacagactctgagggcagggacaaactgacccagcctaaactgcctcgccttccctgctcccgggaaaggggttttccctgagggaaggtagcatcttgccattttcttcctgcacagctttgccttcccagggatccacccattgccacctgaggaaatgccttggagcccatctaatccccagcccagctacttgggacgcctacagagactacattgtcagaggatgcatcttcctctagtcttggagggtttcttttcaatatgatcccaccggtgcatgcaaggctcaattctacatcaaaaaactaggcccactcctgtcgccgagacccccaggcttcaggtcctgtcacagtgaccttgttatcacccccagcagcccccaggtattcactctgcataggctatatactgggtgctgcactagggaggctacctacgtggcgcatgcttcccttatccctgaagagcttaggatgttgtaacttcttcacactaggcctcttacttcttggagatgtcagtatctgggtaaataatccttctaacatccttttggtcttatgaagcccattcttgtcctctgccctacctcagcttccccctccctccatgatcagaccttagaccttgtcaggtccaaggactgcaaccctcacagtatcccactctgaccaccacctcctatctagagcaatggagagactttgtaggtgaaagctgtctttgctactggttctcctatgctccctcgcctggctcctgcaggcggttgacttcaccagggacacagtggccagtgcccagcaggtcccactcctctcaccagctccaggcagttttattgtagagtaactcttctgagacaccgctcctttccccagcacctaaggaagtatttctagtaagttccagtggtatagcatcggtgactctcccgacaagcagagggccatggctgggttcctctgatgaggtgcaggggcagggcactaagaggggaggactctcctgagttctctacctgagccctagactagtagctgctcctcctatacttcctactagtctgtgcctggttactccacttccctgttgcaattaacaattccctatgtacacttttcctgttcaaatgactgtgtggcttctctttcctaatcggactctgaccaatacgctatcatttgccaacaactcccaaagttttatcagtgactcagacctctaacctgaactccagctgcctccatgagatatccatttggatgtttaatggacatttccaaagtgatatgccctacagaactcagaatcttccctctcaaaccaactgctcagcagtcttatgatcttagttgatggcaattcagaagtgaattgcaggacacccggtttgtatctgcagagagaactggagaactgcttagtgtggaaaacccacacatttggtttcagaagtgtgtgagtagaaacagttttccttttatgtttgttggatggataatgatgaacctagcaggacacagaaagctaggcagcagtggaactgagaatgaagttatagttaatagcagagaatgaaaaagaaaagacagataaaacattttgaagaaaggacagtaatgtattcccaacaggtaggatttacaggatggagagaagaggcaaagataactacaaaatttctagcctgagagactggtagaaaaaaatggtggtatcaggaacagacaggggttattaagaaaaaggattggatttttaaaataaagaagatctggtgtaaaattatcctcaggaaaactggaaaactaggcatgtacttctctccatcatgcccttgcacagtgcagtccttctgcctgtccatgcctcgcctccccctccctaggattcctcttcctctcttaagacccatctcaaatatcacctagacttgtaagtaatttacatgaaactggatacctgaggtatccctttgaaagtttttaataacaagttactgttatcttttactaagtccaactttatattcgccattttaactagcatcatttctgtttccaagaggtatttggtgtgaaagtgcaactaagtttactgttaatcaagatcagaataaaagaatctaccaaaaaaattaacaagatcccccttttaatgcataatctttcatccatcaggctgtaagttaaatacctaacataaaagaaagctgtatgttttatggatatgtacatatataactgcagggaatatgatttggaaggatgtacacttagagaagactggagtcacaagtggtagtcaagggagtcttcagatttctttttgtatttcaattttgagagaaatacatacatatgtattataattttaaatttttaatgaaaaaaagtatttttccttttttttcttgatctgtcactacattatatttttccaatatcagctaaacatttgcttcccagaaagcttagttgtcttttcaaaatttattcaggttaaaataaaagatttagacaatgaattaaaaatctaagatggtatttgcctactttatacagaacagtacattgatgctgctaaagcaattaaagtataatttttctttttttttttttttttttttttgagatggagtctcactctgtcacccaggctgaagtgcagtggtgcaatctcagctcattgcaacctctgtctcctgggttcaagcaattctcctgcctcagcctccccagtagctgggatttcaggcgtgcaccaccacgcccagctaatttttttgtatgtttagtagagacagggtttcaccatgttggccaggctggtctcgaactcctgacctcaaatgatctgcccgcctcagcctcccaaagtgctgggattacaggcatgagccaccacacccagcctaaagtgtgtactttttcttagctcctatatgcagtgctccttccccatactgaatgtctgaatttttatctgagacatagtatttcagatggtcattacttacgggtggtcattaatagttcctccctgcttctaaccttcctctcctcattttaaattaaattacgctacattattgtggattagaaagtacattaatattaagtgaaaaaatatgatctgatgagtaagtggcaagagtgttaacgtatgaatattaagagttgttctgaggcctttttgcttttctgggggttctgtgcttgtggtagaactcttggttattttataaatagttcctgaaaagtgagagagtacagctggaaatcagatttctgatgaataaatcaaaccctattaagagaaacaggttcaagtaattttaaaaccatttgaattttcataaatgttttgttaatgattaattataaaaaaaaacagtgactctagctggaggcttttgtgtgtttgcttttgagtcagctaggaaaaggaagaaaaattcaagcttagtcaattgtggttttcactgaatcttttttaaagtaatgagctggtttgttttcttcatcactatagcaacttaagctagtttttgcttttgatttttatttctcctagagaaacttagcatgcactgctcattagacttgggcatactaaggaatatctgtggtaattaagttaaaaatcagatcagtgctttgtgctgtgtatagttgcagatgtctgcatttcactaatattctttggaaacatctggataccagttaacataaaataactgtttagttggtttctgttcagaatagaaggaatgacttaaaagttcccattgtagtacatacgtcattctatccctagcccttcctccagctttactgagattgataaataataaacatcatgggtggtgtgtctttagtttcctctggtgagctggatgcacagattactttgtcagcagggtggtcttgatttttaggccatgtgtctaatggcatcagctctgtggccgacacctgtgtaccaagcccattcactatctagcttagccagccgtggactcctgctctttgttaaaagtatttaccttcattcctactagcacagttgaccaaagacccagttgatcccaaacactagtaatgcatcaatggagtctaacagagttttaagatgtgtgtgtgtgtttgggggtggggggtgtagagatgggatctcactattgttgtccaggctggtcttgcacacctgagctcaagttctcctgcctcagcctcccaatgtgctaggactacaggcatgagccaccatgcctaaccctctaagactttgggatacaaaaacataatttactttccttcatttctggaataaaacatctcttcttcctccccctactttctgttctgtgcccctgtttgatctctgttggtcctgttcaccttcagccttctctgctgaaggaggaaaggcttggttttataaaaagtgacaatattcagaccacataagatccttcttgcttcattttggattaaatattttaagattttctgattttcttgtatgcatatgtatttacctattatttgactttattgaataacttcaaattgagtatatttgaatgggaatgggcattaaaaagtgctaagctttccctgcctttcagaactttgtatgtatatgtcacatcattttgtccttcacattctccagttgtgctaatttttcccaatccattaagtagagtaccttcctttttggagtcttacttttttttttttttttttttttgaggcagagtctcaaaccgtcgcccaggctggaatgcagtagtgcaatctcagctcactgtaacctccgccttagcctcgtgagtagctaggaaatacaggagcatgccaccacacccagctaatttttgtattcttagtaaagatgggggtttcaccatgttggccaagctggtctcgaactcctgacctcaagtgatctgcccagctcggcctcccaaagtgctgggattataggcgtgagccaccacatccggcctccttacttaaatatcttaatgtgccttagaatgtagttaagaattttcaggtgacagtatatttttgatagttatctttggtttccaaacccagagaaggaagagtaactggctttttctctgtgtgggtacattgtgtcttattggagattgttttgtctcaagtattgctgcagactattttattaatgggtgcaactttaaaatttttttttttcagattaacggtttaggtatcccagtactcggtatttgccaatttctagaattaaaaacatgtgtgtatcactggttaactagaaatttaaaatgaaaatgtttcttctttagcccaggcaatatcacttgcattcacttctatcccctccttgtccctactctgttggctccagggcttcttccactaagctggtactttctttatacctcctgtacttccattcactgaacctttattggttcatagcctacagaaaatgcctgtggtgtgagaggtaatttgtgaaactgcttctcttcactgtttagcaggttgagctctctaaatgggtgtagctgggaaagaaaatttaactttacaaacaagaattcctgggttccatccagtggaacatgtcttttgttatacacacacagtttctgactcatatcattccatgacttatgataaaatggacattctgtttacactgttgtgtggaaggaggggtctggttcctaatttttagtaacatctatttctagaatattaggcttgccatttgaatgcttctgtttgatttatgaatatcattggttccagcagtttttagctccctgctaaatgcaagttaaaatttttaagtttctaagttaaaagaaagtaacttttcctccacttaagaaagcaaggaaaattaaaaataatgtagtgatgacttccacaggctctaaaagagcaatgaaaaaagtgatttatgtgtgggagaagaaatactagttcttaattaatacattgttttaccacttcccgtgaatttatgtagaagtaatgaaaccaaggtttaagtcatttgttcaaactcctgtcagtttagactttttaattgctttgttacatgccattgctttgtaatacttgttatagcagtggtaacagttgagatttgcctgtttgaccacttgcagggcaccgtgccagattccccatgtgcaatgttcctcgcagttgtgacgcccatcgtaggagggcggcgttagcacccctccatgcaagcggatggtgcaggctgggtcgcctgggcacagcgcctgactattttcctggcttagtgtagttatcattaaatatgtggtattacttagaagcattttgaataatttgaaaagcacattttagtgttgaaacaatttttttttgagaaaaggtctggctctgttgctggggtggagtgcagtgacctgagcgtagctcactgcagcctgcaactcctgggctcaagcgattctcctgccccagcctcctgagcatctgggactacgggcacatgcccccacacccaactcaattttttttaagatacaaaggattcatcttaatattatttacaatttttttttccttttctgtgggcctcatctgactggaaagcctttcaatttttttattttttaaattgtaaattgacaaattgtagatgtatatttatgaggtacaaagtaattttatgatttatgaatacaacattacataattaagtcaagctgattaacctgttcaccactggaaacaattgcaaatcattatcattttttctggtgagaacatctgaaatttactcagtgattttgaaatgtgcagtactttttgttgttgttgtagaaatgaggtctcactatgttggccaggctggtttcaaactcctgagctcaagtgatcctcccacctcagccttccagtgttgggattacaagcgtgaactaccatgttgggccaaatgtgtaatctattattatttactgtattcaccatgctgtgcaatttatctccaagaaatgtattcctcctgtctaattgaggctttgtgccctttgaccatcatctccccgtcacccccatccccaatgttgtatactgagtcctttcatgatatgtatggaggcttatggtaagttatttaaaagtacatgtatgtcaaaattttttgtggccatagcttttctttctttttaaaattttaagagtcagaatattcgtatattaattcagcatgtatttgagtgcctaatgtatgccattttctatgttaggaaccaggaattaaagcagtgaacataacaaagtctgccctcgtggtgctaacttgccaggtagggaagccagatactaaacacatgtataatgcaaagtcagtaataataaacgatatgaagaaacaagtaaggtaggagaggcaggaaagtgggagtgagaaagaggtgctcttttaaatacagtggtcagggagagcctctcagaatgaagtttttaacagagacctgaatgagatgggggagtcagctatacagatatctgctgtgtgctagaaaaattacctgtaattttgcattctaaaagtttaatgagtacatttatttcacaatttgagaatcaattatatacaagatatagttgtaagcacatactcccctaaatataatttgtttttacagtagaccaaataagtatgttcagcttagaatatgctctttatgatctgtataataaatacattctcttaaaatattattaatattaaggttgatgttttcagaaacatataaaaaagctagcttttaaaattgactagggaagttctctcaaactgccagtccctgagatattgtatattttctatctgaaaaacttttattctcagaattctttaaaagagctgtccctgaggctcccattacttacctgtgactcccagtggaaatcgtacccagcccctcgagaggggctgaatctgttgagagtgggagggtagaaaaaatgctgcagcttcttgtgggtaaacttcacacacaaacacccagtgccccaagcactgtgcagtcaaacatcaaccctgctcagactttcctccttgggattgagaagcaatggattatagagaaagaaaggtggcttagcactccaaaacttggaagggtaattgaccaagaccccccaaagccaaagcagtgggcatccccactttctgtataccctataccaacacgtaatggctactagatacaggggcactagtacctgtctgcttggctacctccccttcttgcagaagtggtgaaggcaatcactcaacctcaggaagggaaaatggctttctcatcttcaaattgaaagaggttggcagtgggtgaggagaataacaagtaaggatctctttcaatatacccatttgaagccaaaacctctgtttagacatacggtattttgaacctggtgactattcattgaccatgtttgtgaattatcagaaagcagaattcttgccaggcatagcggctcatccctgtaatcccagcactttgggaagccaaggtgggaggatcacttgagcccaggagtttgagaccagcctgggcaacatggtgagatcttgactctacaaaaaattcaaacattagctgggcatggtggcatgcacttgtggtcccagctactcaggaggctgaggtgggaggattacctgagcccaggaggttgaagctacagtaagcagtgtctgtgccactacgctcagcctgagcaacagagcaagaccctgtttcccacccctacccaccccctaaaaaagcaagctgaattcttgaactccctgcaaccaggtcacgcaaaccaaaggtaaaaggaacataaaaaagccttctggaaagtgtacagaaattcattgcagggtgatttttgtcttgtgaaatcatagttactgttattagcagcttttttaaatgttttatattcattttttatggtgttctgatgtatgagctgcttcaagtgtttttggacatagcttgggtataaaatgtaaaaagtggatattttcaatttgtagctttcttttttgaaacttactgaaatttgttctaaatatatctccttctttctcacccaccccaacacattttttaaaaaacaccaccaggtatccgttatagcactgatgtgagtgtagatgaagtaaaagctttggcttctctgatgacatacaagtgtgcagtggttggtaggtgatcgcttttcttgctacctaatgagaactctggggaaatatgtttacacacatgttactgttaagatgctatagaaatataccttatcagaactgatttttttttaagttgtactctttaagacctgcatcatttttcaattactctaaattaagatatagcctttttttacgggagggattttttttacgggagggagctaattggattttaagtctagatctttgttttcaattcctcaacatattctataaataagaccaaattatagtagaaggagagtaaataagctattatctttttaaagtggtgaagagcactgattaaatatatattagagccccagcccccgccccagctgcgcgggcccccgcctggcccatggactgcacagcccagcgggcgccttgagcgcggtgcgggtcctcggagcacccccgaggtgagcgcaagcaaggtccggcatcatgtgctaggttattcccagtgcgaggccacacttgggccgtcggagcagcccctcctcacttcaggggtcaccctccccaagacccattgccccatcatggccggggaccggctccccaggaaggtgatggacgccaagaagctggccagcctgctgcggggcgggcctgggggggcctggtcatcgacagtcactccttcctggagtacaacagctggcatgtgctcagctccgtcaacatctgctgctccaagctggtgaagtggcggttgcagaagggcaaggtgaccattgtggagttcatccagccggctgcacgcagccaggtggaggccactgagccacaggacgtggtggtctatgaccagagcacgcggccgcagacagcttcctctccatcctgctgagcaagctggatggctgcttccacagcgtggccggctgcttccacagcatggccatcatcacggggggcttcgccaccttctcctcctgcttccccgacctctgcgagggcgagcctgctgccctgctacccatgagcctctcccagtcctgcctgctcgtgcccagcgtgggcctgaccctcatcctgcctcacctctacctgggctcgcaggaagacgtcctgaacaaggatctgatgacgcagaatggaataagctacgtcctctatgccagcaactcctgccccaagcctgacttcatctaccagagccacttcttgcaggtccccatcaacgacaactactgtgaaaagctgctgccctggctggacaagtccatcgagttcatcgataaagccaagctgtccagctgccaagtcatcgtccaccatctggccggcatctcctgctgtgccactatcgccatcgcctacatcatgaagaccatgggcatgtcctccgaagacgcctacaggtttgtgaaggaccagcgcccgtccatctcgcccaacttcaacttcctgggccagctgctggagtaccagagcagcccgaagctgctggccgccgtgcagggcgacgcgggcaccccctcaggaatgcaggagcctccccccagccctgcggccggggccccactgccatggctgccaccacctacctcagagaccgctgccaccaggagtgcggctgccagggagggcggcccgagcgcgggcaggaagcccccggcgccccccacggccaccagcacgctgcagcagggcctgcgcagcctgcgcctctcctcggaccacctgcaggacaccagccgcctcaagccctccttctctctggacatcaagtcggcctacgcccccagcaggcggcccggcggcccgggcccagcgaccccggcgaggccccgaagctctctgaaagctggacagccagtcggggccatgctgggcctgccctcgccctgcccggacgccgcgcccaggcacacccacggcccggcgcgctatcccgcgcgcggcctgaacttcggctacgcggctgccgggccctggccagccggccagccccggagcctggacgccaccgctcgactccctgaagcgtcctcggtgcttcagccccgagggcgtgcaagggccgggcagggtgctgtttgcgcccttcggccgggcgggcgccccggaacccaacggctgcagcgacctgccacggcgggaggcagcaagggctgagcccgggacgcgcggaccagctggtcagacgagctggccccggattcgcacttcaagtgctgcagctgccagatggagttcgaggagggcatggtggaggggcgcgcgcgcagcgaggagctggccgccctgggcaagcaggggagcttctcgggcagcgtggaggtcatcgagatgtcctgacccctccgctgccctcggctccgccgcccgcagctgggcagttataaatatatattatatataatgcaaagaaaggcaaatggttttactgcgatttttatccagaagtaaatatttcgattttttatttatttaagctgttcattctggcactgatttggcaacagtgcgggtggtcctcgagctctatttttactgtctggtatttaaaccgaaacacgcgtttctaagcaataagaggccaccttcagtcgcaagttgcaggccaggcctggggcccctccctgttcccccgccccaggaaacactgctgacatttgcagaggctgccgagctttcgtgaactttttacacaagagaaagttgaaaaaaaaaaaaactttcttgccacaaaccgagccgcagaaacacccttcttcccccacccaccgcccctgctctctcccttcgggctccgccccaaagccataggctgggggagcaggacctggtgtgccccagagaggtgcggccagccctccaccagctctaggcaccaaatcttggtggcagggagggcaccccgctgcccgttgccccagagctgttccctctcaggggaggacatgcattgggccccatggtgccagggcgttgagaggggctgaggaatagaacagtgtgtgtaggggcttggggcagggggttctggagggtcagatgaggcggagcccaggggaggatgggggtgttattaatgccccaactcctgccagagccccagtccagccactgagtgcctcagaaaggccattcccagagggctgcggccctcccttctcctttgcccctgcccccagagctacctgactggcagggcggcactactgcaggagaggagcttggcctccgggggtcaggcaggaggggggcctggctagcctgtgctggctccactgggcggggagccctggaccgccaggtatgaggagggggtgggcttagggtcctgttccaggtccgtcccccacctagcaaggccccaggcaggacttggaaaccaggtgtgcacctgcaggctgaggggctccatgagcaggtgctgcctcgcacagggagttcaggcgccagccaagcccctgtgcttctggggtaggcctgcttcacttagggagcgctgcctcaaggcagataaagcccccttgttgacccgacctgcatgggggcctctcaggagagaaactctcgtgcgcccctttcccagggcgccctctttctagacagcattccagcccccaaacacaggtggcttttgggcccagatgggtcagcctgctgctcctggcccataccctctcaggccgttgggactcctgcccttcagatgtcctagggtctaggagtgggccagtcaccctgggaagaggccaggggcttggcaggaggggcggcccaggcgggacccagtcctgagtcctggagcagggccagggaggcgcccgccccaccccagccagccgccttctctgctgtttcttctatttgttcttcttttcacccacagccttgtgttcctgtcaaccctcctttcagcaaaagtcctgttcccgttccctctgtccccacccactcctgttccccaagaaaataagctatcattgttgcatttgcaatctatggattagaggtttaagtatttattattattggttaattattattatgttttatatatatatattagaacttggctagccaattttattgaacaattcctgttcaataaatgttgtttaaagtacagttgagaaaacgatggtaggtttatttcttgaactttcagaaattcaagcttaaagcatcacacgtttttctaatatcatgtggcgctttctgtcattttacttttttaacctttatatggaatagcaaccatcaaccttctctttcagatgtgccgtttgggggtgctaaagctggtgttaagatctatcccaagaactataccataagtatgaaagtttttgtttttgtttttgtttttgtttttgcttttttgacacagagtcttgctctgtcgcccaggctggagtgcaacggtgcgatctcggctcactgcaacctccgcctcctgggttcaggcgattctccttgatccagtaactgggattacaggtgcatgccaccatgcctgactaatttttgtatttttagtagagagggggtttcaccatgttggccaggctggtcttgaactactgaccgcaggtgatctgcccaccttggcctcccagagtgctgggattacaggcatgagccaccgcacccggcctcaaagtgatatttgtgcacacagtgcatttatgaaggacttgaaattactgggcttctctgtatcccccatatcagtgaaatcaatagtccccattgcttttcaaatggaatgaaaaaagtaaagaattaactcattgagtgttttgccatataaaggtcacctacttaatatctatatcctttatcattttctgttttgtttggttttgtttttatgagtcttgttttttttttttttttttgctttttgtattattattttcttatttaaaaggtaattaatatcttcatattattagacacctatacccatatttaagaagtactgtgatctggctgggtgcggtggctcacgcctgtaatcccagcactttgggaggccaaggcaggcggatcacgaggtcaggagatcgagaccatcctggttaacacagtgaaaccccgtctctactaaaaatacgaaaaattagtccggcgtgttggtgggtgcctgtagtcccagctactcaggagactgaggcaggagaatggagtaaacccgggaggtggagtttgcagtgagccgagatcatgccactgcactccagcctgggtgacagagcgagactttgtctcaaaaaaaaaaaaaaaaagaatcactgtgatctaattagccaggcatagtgacgcacacctgtaatcccagctactcgggaggctcaggcatgagaactgcttgaacccaggaggcagaggttgcagtgagacgagatttcaccactgtattccagcctgggcaacagagcaagactctgtctcaaaaagaaagaagaaaagtagtactgtgatctgaagtttttaggtcaggatctcatgctagtgacaaatatcttaactaagccaataaaaaccttactttttatcctgtcagttccaagtaaattcaaactggttgtcacaatgctttacataatactaaattatctatatacaaacataaacagatatgatttttattctctttaaaattcaccatttagatggaatataattatattacaattaatcttaattaagatttggtatatttttcagtggggaattaatagaatgggaatttgagtcctggttctactatcttgtttttataacctacttttttgatcccttattttctcacctttaaaatggcattgcctaccttatgagttgttctaaggatgagaagacatgaaaatgtactataaatagaaaataagatgctagctataatctcaagcgatttttgtatctttttttatttttattgttttcttattttacaggataacgaactggaaaagatcacaaggaggttcaccatggagctagcaaagaagggctttattggtatgtgtagccacatagattttggcataaagtgggaacatctaaaaaaatctttttttttttttttttgagacagagtcttactctgtctcccagactggagtgcagtggtgcaatctcctccacctcccgggttcaagcaattctcttgtctcagcctcccaagtagctgagactacaggcatgtgccaccacacccagctaattttcgtatttttagtagagatggggtttcgccatgttggtcaggctggtcttgaactcctgacctcgggtgatccacccatctcagactcccaaagagctgggattacaggcatgaaccactatgcccggcctcctactatttgtgataggagcttttgccaaacatacaacatttttgaagacactgatcttcgtttgcttgatgtcttcgtatcttactattatctgtgtttatatgttctttgtgtgtgatctgaacattctttcctatgatatgtaaatatttgtcatttaccttctaattttcaggcagtttaaacctctctatacatatatttttaatctagaaggcttctaatttgtttgaatagaatatacataattatttaataaaatgcttgccctatcagtatagttaatagaatgttaatagttacttaataatataatacttgccctatcagtatcagtatagttaaacaaaataaggtctacttaaataggaaataaagtgtatttttctctactttctttctcagcatttcccccaccatggacaaatgcctatgaaattaaactataaagtctgggcatggtggctggtgcttgtaatcccagcatttttggaggttttggaggctgaggtgggaggatcacttgagcccggaagttcaagaccaccctaggcaatatagcgagaccccgtctctacaaaaaatgaaaatgttatccaagcgtgatggtgcatggctgtggtcccaactactaagatgggaggatcccttaagcctgggaggttgaggctaccatgagctgtgatcatgccactgcactctggcctaagtgacaaaacaagaccacatctcaagaagaaagagaaaagaaataaagctattcagattcatttttaggaaaaaagtcatgaaataaatgtcatgaaataacctaatatagaaatacagtaagtataggtaactctaaaacttgactagatttggcctgtctttcataataaaaggcatttgggcctttgacgtgccgcatacccagcactactgtgaatttgtgcatcattacgaggagcctattaacatgagtgaactatctcactcacacttttataggagtacctaccgattctgagatatggtgaattgaagtcatgttcagcctgttaatagccttcataattttcaaaaggtctttcctcctcacctaaatctcaaacacattttatagtcttgaatggtttcagactttattcagtcatatttatcgcccatatctgcaatatctccagctaaattttatcagtcttgacaagtacctaataattccaaaggtcaaaaagtgattcattggaatactgaaagaaaacacagcttaaactctagtaacttgatttatttgcctaattcgcaaaggcctcattgacccatgatgcagctaaattgacgtcttggcccagacagctttgaagcctaggaggcaggcaaagggagttttttctctcacttctcggcaaaccttcaaattcgatgctatttatctgttatttcctgacactccacagagagtgtcagattgaggctcagacctgagcctgagccctgatcctatcacatgtgtgtttagcatcagcttgtaaatttctacaaaacaaaacaaaacaaaaaaaaagaggctgggattttgataggaattgcattgaatctgcacaccaatttgtggagtattgccatcttccccaccctccccaaaagggttttgccctttcacccaggctggagtaccaggcagcagtcactgcaaccttgacctcctgggctcaagcaatcctctcacctcaccctcccaagtagctagaaccataggcgtgcgcaactgcacctggctaactttttaattttttgtagagacatggtctcatcacgtatcccagactggtctcgaactcctggaatcaagcaatcttcccacctcagcttcccaaaattctgggattatgggcatgagccactgcacctgaccagtattgccatctcaaccatattaagccttccaatgctgaatatgagatgtctttccatttatttaggtctctgatttctttcaatgatgttttgtagttctcattgtagaagtcttacaactaagtattgtattccttttaatgctattctaagtgacactgatctatcgttttcttatgatgtctttgtctagtctttgtatccagacaattctagcctcatggaatgagttgaggagtgttccttcctcttctgtttttggaaaagcttttgaaaggtcggtgttcattcccttgtgtgagtgtaaatatcacctatgtaaagttctgcaggaccctgatgtctccacccttctcatccccttatatctctgtgcaccaaaattaccctttcatctcctactctatagtcacatgctgttagaaaagttgcttttttaaaaaagatgaacttctgcctcagaccgtgctctctatataagaatttacctgttaggccagtcgcggtagctcatgcctgtaatcctagcactttgggaggccgaggcaggcaaatcacctaaagtcaggagttcgagaccagcctggccaacatggtgaaaccccgtctccactaaaaatagaaaaaagtagccaggcgtggtggcgggcacctgtaatcccagctactcaggaggctaagggaggagaattgcttgaacctggaaggcagaggttgcagtgagctgacgtcatgccgttgtactccagcctgggcaacaagagtgaaactccgtctcaaaaatataaaaattaaaaaaaaaagaagaacgtatctgttattcaggagctacttgtaatctgtgcatcccaatacattagttttgtatggagcagaaaactagtaagcctaataattgataccttgtgattttgttttgggtgggtgaagctgtttcatgtttaacatgtatagactgtttttgagaaggattttatcattatatgtttgtgatttacaaactgtgtgcttcagacttgccacttgccagagcccttctccaattggaattgttttttgtttttgagacagtctcactctgtcgccaggctggtgcaccgtggcgtgatctcggctcactgcaacatctgcctctgaggttcaagcaattctcctgcctcagcctcccgaatagctggcactacaggcgcgtgccatcacgcccagctaatttttgtatttttagtctacaacggggtttcaccacgttggccaggatggtctcgatctcttgacctcgttatccacccaccttggcctcccaaagtgctgagattacaggcgtgagccaccgtgcccagccagcttttttgtttttaaaatatattgtttaatcaagatgggatctcactatgttgcccaggcttgtatcaaattcctgggctcgagccatcctcctgcctcagcctcccaaagtgctgggattacaggtgtaagccactgccccagcctagttggaattgttgtttgaggtaacaagcttacttaatcctaaagcaagcataatactttcgtagatgcctctagaaagattcgggaccaatttgtcatttgtacattgggagaaaaggagtggttaaacaaagttttactgacctccagcagaggtatgtcactaaaggaatggaaagtgagcaaacaggagctggagagcaccagagagcccttttgtcagtggatgaggctagaatatggcattaatccttccaagtgctgtgtggggttagacttctcatgaaggataggtttgggtaggttagacttcatgagattttttctgtttttaagttttttgttgtccttgttgacttcatgagatttttaaggtgactaagggaagggtgctaagacatagagttacagattaggtgggaggtggagagggttggggtataaaaagcagtccttgaacatttcaaagttgtcttataccagccctgtatccaatatatcacatcttgttcaaagaagttgattatctaggccttgggcccctgagttaaagaaaaacattacagtatactgattccgtcgactaaaaagtaaaatttataggaagaattgagtacagtccttagaaagaactttaattattttatggggggacataatggtttaatagtttaacctctttttttttttttttttttgagagacagagtctcgctttgtcacccagactggagtgcactggcgcaatctcagctcactgcaacctccgcctccagggttcaagtgattctcctgcctcagcctcccgagtagctgggattacaggcacttgctatcacgcctggttaatttttgtatttttagtagagacggggtttcaccatttggtcaggctggtctcgaactcctgaccttgtgatccactctcagcctcctaaagtgctgggattacaggtgtgagccacaacatccagcctaatagtttaaccatttttaaagttgtgtttttctttttgtaaagatgagtttctattatacagttgaaataatatagaaagttataaacaatatatatatggtgggtagaaagaatggggaagagaaagaaaattgtaagtgggaacatgttatacatgttgtatgaaacctgcctttttccatatgtatgtttgtgataattccaagtaatttacatgcatatgttatcctttttaatggctgtttagtactttgcataggtataccatagttcatttaattgacatacaagataattagattgtttttatttttactatgtttgagaggagtatttctgcacctttacggatttgagtgagcatcacttaacatgtttttatcagagatcttactgtagccgtcagtagtagtgcagtcagtgatttctgttattgcctgtaagctaatttgttagcctaacacttcaatttgctatgatctgaggaactgaaagctaaggcctaaaattttatatgtgctaagtgtcgaataataggtcaaagctgcattcttccacaagtaaagataatatggggcttaacacaattgctttagcaatgtgattttctcccctttttctctacttggtaaggagggcttatacccccactaagcaggcacatgcctgtaatcccagctactcaggaggctgaggcaggagaatcgcttgaacctgagaggcagaggttgcattgagctgagattgtgccattgcactccagcctgggcaacaagagtgaaactcaaaaaaaaaaaaaaaaaaaaagaaagaaagcaagcaagaaagaaagaaggaaggaaggaaagaaagagagagaaagaaagaaaagtaaatctgtggatattgtacaaaagattgttttatgattttttaattttttaacataacttttattgacttgtatttgtatttttatcaaacatacttcatttgtttatttatttattttgagatgaaatctcactctgtcacccaggctggagtgcagtggtgggatcttggctcactgcaacccccgccttccaggttcaagcaattctcctgcctcagcctcccacgtaactgggattacaggcatgagctaccatgcccaactaatttttttattattagtagagatggagtttcaccatgttggccaggctggtctcaaactcctgacctcaggtgctccacctgcctcagcctcccaaagtgttagtattataggcatgagccaccgcacccagcctcaaacatactttagacaatttttcacctcagcactattgacattttaggctatgtaattctttgttatgggggctctctctgccttgtaggatgtttagtaatatccctggcctctacatattagatgtcaggaagacccctcagttataacaatgacaaatatattcagattgccaaatgtcccctgtggagcaaattcatcccttgttgtgaactgtgatccagagagccaaatagtgatacaaggtttattgttcacaatagctcgtcccctccaatccagacatctgcctcaccatattccactccccagaggcaaccactttcaacaatcttaaatgtttcatttttattctatttaaagcctttgctcatttttaaattgggttttgtccacattattgagtggtaagagttctttatatactccacagccagttgtggtagtataggcctatggtcccagctactcagaaggctgaggcaggaggataacttgagcccagaaggtcaacactagtctaggcaacatagcatgaccctgtctctaaatgagtctttgaagtatatatattctaggtaattgacctttatcatgtatataatttgtaaatatttcctctcaatctattagttgtcattgcgctttcttgatagtctcctttttaatcttgagaaagcataatttatttttcctctggttggtgtgctttaggttgtatgtaagaaaccattgcctaatccatagtcatgcagatacatccctatctttttttttttttttttttgagatggtctcgctctgtcgtccagattggagtgcagtggtgtgatctcatggctcattgataactgcagcctctacctcctaggctcaagcaatcctcccccttcagcctcccaagtagctgggactatagcaccagctatagtcagcctcccaggtagctgggaatatggcaccaggactatagcacataccaccactaagcacagctaatttctgtattttttggagagacaaggtctcaccatgttgcccaggccagtcttgaactcccaggctcaaacaatcctcccacctcagcctcccaaagtgcaggattacaggtgtgagccactgtgcctggcctagagagatttttttaagaaatagtgaccaaaaatatcccacatttgatgggaattgtgaatctacacattgaagatgctcaacaaattcaaagcaggataaactcaaagagatccacactgacacacattataatcaaattgtagaaagctaaagacagaaaagcagcaagagataagtgattcatcctgtacaagggatcttcagtaagactaacagttgcttatcagaaatcacggagtatagaaggcagtggtggtgtgctgggcatggtggcatgtacctgtagtcccagctgactgaggctgagacaggagaattgcttgagcctgggaggtggaagttgcagtgagctgagatggcgccattgcactccagcctgggcgacagagcaagactccatctcaaaaaaaaaaaaaaaaaaacagggttggggaagctcagcatggtggctcatgcctgtaacttcagcacttttggagactgaagtgggatcacctgaggccaggagtccacaaccagcctgggcgacataaggagaccccatctctacaaaataaaaataattagccagacaaggtggctctggcctgtggtcctagctactcaggaggctgagacaggaggattgcttgcagccagcagtttaagactagcctggacaacatagtgagaccccgtctctacaaaatataaattaaaaaaattagctgggcatggtggtgtgcatctgtagttccaactactcatgaggctgagacaggaggatcgtttgagaccagaagttggaggttacggtgaggtatgatcataccactgcactccagcctggttgacagagcaagaacctgtcactaaaaaaataataaatgaataaaaatataagaatgcttggcctggtctgggcgtggtggctcacgcctgtaatcccagcactttgggaggccgaggcgggtggatcacctgaggtcgggagtttgagaccagcctggccaacatggagaaaccctgtctctactaaaaaaatacaaaattagccaggcatggtggcacatgcctgtaatcccagctactcgggaggctgaggcaggagaattgcttgaacctgggaggcagaggttgcagtaagccgaggtcacacccgattgcactccagcctgggcaaaaagagggaaactccacctcaaaaaaaaaaaaaaagaaaaagaatgcttggctgggcacagtggctcatgcctgtaatccctgcactttgggagtccgaggcaggtggatcacctgaggtcaggagttcgagaccagcctggccaatatggtgaaaccccatctctactaaaaatacaaaaatttgctgtgtgtgatggcacgtgcctgtaatcccagctacttgggaggctcaggcaggagaatcacttgaacccagaaggcagagtttgcagtgagcagagattgcgccactgcactgcagcctgggcaacagagcaagactcgggctaaaaaaaaaagctgaagtgagtccttcaggctaaaatgaaaagatacaagataataactcagagctatatgaaaaaataaaaatcactggtaaaggcaactatatagctaaatataaaagctagtattattgtattttgggtatgttattcctctttctcctttatgatttaaaaacatgcatgaaataatatgcatctatgttaataggaactaattgtttaaagacataatttgtaacaatatagctaggggacagagaaaggagcagagttaatgtatgctattgaagctgagttggtatcagtctgaactagacttagaactcagcatgttaactgaaatcttcatagtatccactaaaaacaaaactttaaaaatatacagaaaaggaactaagaaaggatcaaaatattacaggataaatcattaaccaaacacaaaagaaggtactgaggagcaaaacactttatgtagaaactaaacagcaggatgacataagtaagttctttggtgtgtgggtttttctgtttttcttttttggggtttctttgagacagagtcttgctctgtaactcaggctggagtgcagtgtttcattctcagctcactgcagcctttgcctcccaggttcaagtgattctcagcctcctgagtagctgggattgcaggcgcccaccaccagacccagctaattttttgtatttttagtagagatgaggtttcactacattggccaggctagtctcgagctcctggcctctagtgatccacccgcctcggcctcccaaagtgctgggtacagccatgagccactgcatccagcctgtttttggttttttttgagacagggtctggctctgttgcccaggctggagtgcagtggcacaatcacggctcactacaaccttgacctccgcaggctcagctgatcctcccacctcagcctcctgagtagctggaactacaggtgtgcaccaccatgcccagcttatttttctattttttgtagagacaggagtcttgctatgtcgcccagcctggtctcaaactcctgggctcaagcaatctgcccacctcagcatcccaaagtgataggattacaggcgtgagtccaaccataagtaagtttctgttttttgtttttgagtcaatctcactctgtcccccaggctgaagagcagtggtgcgatcatggctcactgcagcctcacctccaggcgggagccaccgtgcccggtcaagtaacttttctgtttcagtaatcactttcaatgtaaataatctcatcaatggaaagatcggcagaatcaatttttttaataatgtaatacataatccaaatatgcaactcacaaaatactcactgtagacccaaagacacaaatttgttgaaactgaaaagatggaaagagataatccatgcaaatagtaaccaaaagagagccagggtggctatactaataataccacacaaaatagattttaagccaaaaactgttacagaaaaacattttatgttcgtaagagagtcaaatcacaagaagatgtaacaattataaacacatatgaaccaaaaaaaaaaagggctccaaaatgcacaaagcaaactaataaaattgaaggaagaaacaattttacaatgatggagacctcaatgcagtggctctatcacagctcaccgcaatctctgcctcccagactcaagcaattctccagcctcagcctccccagtagctggaactataggcacacagcaccacacccagccaatttgtgtatttttttgtggagacggggtctcaccatattgcccaggctggtctcaaatgcccaagctcaagcaattcacccacctcagcctcccaaagtgctgggattacaggcctgacctactgcgcccagtcaacaccccaccttcaacagtaaatagaacatctagacaaaatcaataaggaactagaggaattgaacaacacactaaaccaactagacctaacagacatatagaaagctctccatctaacaagtgcagaatatatattcctctcaagtgcatatggaacattccccatgataaatcatatgttaggtcacaaaacaattctcaatacattttaaaaggtcaaaattatatgaagggccacatgtgttggctcacagctgtaatcccagcacttagtgaggctgagacaggcggatcacttgaccccagaagttcaagaccaggctgggcaacatggtaaaaccctgtctctacgaaaaaaaaattttaaaattagctgggtgtagtggtggtgaatacctgtagccccagctactcaggaggctgaggcaggaggatggcttcagcttgggaggcagaggctgcagtgacccgagatcataccactacactccagcctgcaggacagagcaggacctgtctcaaaaaaaaaaacaaaaaaaaaaaaacaaaaacaaaacaaacaaaaaaaaacaggccaggcttggtggctcatgcctgtaatcccagcattttaggaggccgacgcaggtggatgacctgtggtcaggagctcaagaccagcctgaccaacatggcaaaaccccatctctactaaaaatacaaaaaattagctggaaggggaggcaggcacctgtaaccccagctacttgggaggctgagccaggataatctcttgaatctgggagacagaggtttcagtgaggcgagatcacgccactgcactcaaccttgagcaacagagtgaggctctgtctcaaaacaaacaaacaaaaaaattatacaaaaaaaaaaagtgaactgcatgttgctgcacagtctaccatagcacaaatgtcaattgcttcttggctttcctggggtgatgggaggtctgaacctaacacagtctcacctgatccttcacaggagtcacgtagcctttctctctccagtccacagatgtggggatctcaagaagcaggcgttcctggaactgtttccccttcctgtgcttctggtattgaaaaccattcatcacctgcctgaattcttcagtggtcttcaaagaaaagtaaataaaatgttaagaagcaagagattaatttggtaaagaactgaggaggggaagcacagagctgggcagcccacagcatacttaccatgtctccaaaggcgttcatggccattgtgaagctgtgtttcccttggctgtattcctgattgtgctgctcagtcatcttcatgttctctcacactgctctcctccatccttcttcattctaaaggcaaacatgtaactgatgttcttcatttctttttttttttgagacggagtctcgctctgtcacccaggctggagtgcagtggcacgatctcagctcactgcaagctctgcctcctgggttcatgccattctcctgccccagtctcccgagtagctggaactacaggcgcctgccaccatgctaactttttgtatttttttttagtagagacggggtttcaccgtgttagccaggatggtctcaatctcctgactttgtgatccgcctgcctcggcctcccaaagtgctggtattacaggcgtgagccaccgtgccctgccgatgctatttatttctaattaaaacccaacatgtgctaaccaagtgaatcttcagacagagatgtaagagtaaccatggccagggaaggcttgacacttctaggagatgttttccaagctgagacacaacaagggtgtatgcccatatcgtgctcataatcagtgctattaagttattgcgttagcttattggtaggagccagcctctagaagccactctctggccatatgatcccaatagcaatgcccatctctctggggttcccctggacagtttcagatgccaccaaccatgtcatataatctcttgtgctttgccttccacttggtccattgtgcgtctaaactgtggtcacgtgttagagcagctgaggcaattcccaggcaaaaggcagccaggaggagtgaaggattcatgtttcaaaaatctaggaagggaaaagaaatgaggatctgattagaccgatcctaaaaagccattttactaccccctgagaaactagggccaccatggtagaataaaaatatttaaattattcttccaagcatttacctaaggactgtggaagaggccaaggatgtggctggagaaaaacagggcaagtggaggtattggagggacccaccaaaatgaaaagcagcctgtccagagctgtaggagttgaaacagttttctgggatgatgatgacaggctatgaaaaggacaggaaggtacctgatgggcgagaagcttaaggcaacaaccgggaaactaggaaaccgttggcccaggttttgtaccaattgtgctgaggtcatccaggcaaaacctcaagaatgaagacatctaatttcaagaagggacaaagggatccccaataattgggaagtcacatcacaccttgttcttggctaatacacaacagaaggtgaagtatgttttccaaatgccccttgtaatgaaacagttattgaatgtcttcccaggacaaactgggaaggagagcacccatctaccgccgttcccgcagtcctgcagtcctgcaggtgggccagtcctgccaacactccagctcccctcacagagcataaactgaatcaggtggccgaaccaccggaagccagagtccccagtgtccgcgcccacacaggggtgggtaggcagcttcccaggctttgggctggggacccaggccaggtctcctggctcttgctcccgccctccgctcatgctcactgtggccccaggacgtgggcgatgttgcagggagcaaggggcgcctctgcctgatttgccggggtcgagcctccctgtcccacccccaccggccctgggaatactgcggcctggcactccggaaaatccctcactcacagagctgaaggacttgctgggtccctggtggcccctgtccaatcttagcccactggggtctcagctgctgtagccacaggtggacaggcacagtgggcaggtgctgggtccaggagtctcctgtcgcctaaggccgcccgaaagcagctaattgacctctaaagcccctagacgcccctgcccccttgccgcccaggcaggcccgcccccaccacttgcccgctctgcgattggctgcgccagccgctgggcggggccttccggcgtgctgactcctggcatgtggagcagctcagtccccttgcctcagtggaaccgggggaggggagctgggggctacgaagagaagggtcggaggtctccctggagggttcggatcaactaagtaccctatttaatgccctgggcgggtggtttatgaaaagaaatttacaggagccctgtgtgcattttcagtttaaccctgcttttcccttaggcctagaatttttgattaaaatctcctgcagggcagagagccagaggactctaatccagtggttcctgtttagtccacagcaaaggtgcggctggctggaagaacgcacagcctgcaagcagaagccttacctcccaattaagggtgtagaagaatctgggcgtgttgctggtggctcatgcctgtaatcccagcactttgggaggctgaggcaggcagatcccttgagcccagtagttcgagaacagcgtgggcaccctggcgaaaccccttctctactaaaaatacaaaaattagccgagtgtggtggcccgcgcctgtggtcccagctagtcgggaggctgaggcaccagcatcgcccagcccggaaggttgaggctatagtgagccgagatcgcaccactgcactccagcctgggcgaaaggagaccctgtctcaaagacaaaaaaacaactggtaggaaaacgcaccctcaaaacacatgatgagatggtcgagaccagaccctaggagggtgggtactggctgggtgggtatccagagaccatgggcgtttcataatgcattgtttcccatctcctccactcagcgactcttcttcccctgaagtcttgcattaagtaagtgaatgaatcaatcatcaagttaatgaagctctgactttgtacttgttgtcctttgcttggtacagttgggcactgccttagaaacaatctccaggtaattttcccaactgcttttgtgaggcccagttttccattttaaaatctaagattacctcagtaatcttgcttttacagcaaatgggcatggagcctgacagatatatttaaactaagttatggacaagctgcctggtgcattaggtagcataggagctaaccttgtgggacatctccccatattcgtaatattcacccctacatctataatcaataaatgcttgtttggaggccatagaaactcttcctgagatctgacctgtgtcttctgctatctgcctgatttctccccatagaacaggaaaacactgtgtaggagatattgtgaatagaaatatgaatataggccgggagtggtggctcacacctgtaatcccagcactttgggaggccaaggcgggtggatcacctgaggtcaggagtttgagaccagcctggccaacatggcgaaaccccgtctctactaaaaatacaaaaattagccacgcatggtggcaggcacctgtaatgctagctactcaggaggctgaggtaggagaattgcttgaacccagggaggcagaagttgcagtgagtgagatggcaccactgcactccagcctgggcaacagagtgagactctgtctcaaaaaaaaaaaaaaaataaattacaaaaattagccaggcatggtggtgggcgcctgtaatcccagctactcaggagcctgaggcagggacaacggctcaaacctgggaggcagaggttgcagtgaaccgagattgcaccactgcactccagcctgagagacatagcgagactccatctcaaaaaaaaaaaaaaaaagaatataaataggaaatacagtgattcaaataagcaattgttagttcctcagatcagaactgtgagttctatactagactcttacatgttatttcttctggtatcttagcaatgattctgaataaagatcagactccttagtcggcaggtgggacagttctcaataacagaagctgggttctcaggggatcccgtggatatgaggatgaaggttagaagcacttgggaccatacctgcaggtctgatttgaggacaatgagaccaagacaggaaggcagcacctgctgaggggctgggggtgggagaagggaggaaacgggacacaagaaaataagtataaaccaccagactgcagtcagtgatcaacaaaattcccaagtttatattgagaagatttccctggtttggggttttgaagagattatataagggattcgggttgcttgatttttttcattctttttcttttaacttggtctcaatttttttgtaaaaaaaaaaaaaaagaatgtcttatgtgcgcctttagaactggtgaatgaatgaacctccctttttaaataactgagattgtcactgaagcactgtcatccgatttaggcttaaaaatctgacactgaatttatcctagatgataaagtgcaagtctcttgtctcctagaaatgatcaggcaaggaaacacccaggaggcccagggcaaaatgccctcctggaagctggtggggtaggaagatgctgaggcccagtatggtccctggagcatgcattctgtgtggtgacagaaattgtttgcttgaccgtacattggtcaggcttctgaaccttctgctaaacccatctgtgcactttttgtaaaattcagttttaggaaattaccctgctaagtcagtttagctggcaggaatccccgtccaccatatactgatcagggtcctcatcccccaccatcccgcagctgatgtcagataaccttggcctgtgctcagcgagaatctcgttaggtcagtttagccagaatcctcccttacccttcatgttccctcatagtcatttcctatctgctaacccccatcctcctccttgagtataattaccacttccttgtgctggattcagagttgagcacaattgctctctctcactgtaagaactacttgcagtgctcctagacctacatatgtgaacctgtttctttaacagtgactcacctgtctttttctcctttcaacttgacactagctgaggcttatccgcatcaaagtggagggactggccccgggggatcctcagggcttcaccttgatggcctgcaggctcacattccactttttctggtgccttctggctccgagtccagtttgccacacaagtgatggaggttggaaggagggatgaggtgacagaggtgaaggagggtaaattcttttctaagccctacttgcctgacatgcatttaggtttttagaaaggaacctgaccccaccctttattttctatctcccacttccatgactagccttacctgtaaaaatggggcatagaagagcccccatctcctagggcagtgtttttgagcagggggtcactgaacagtagcaccttcatctcttgggaccttgttaggaaattctggacttggggtggttgatcatgcctgtaattccagcactttgggaggccgaggctggcagaacacgaggtcaagagatcaagaccatcctggtcaacatggtgaaatcccgtctctactaaaaatacaaaaattagctgggcacggtggtgtgtgcctgtagtcccagctaatggggggctgaggcaggggaatcacttgaacctgggaggcagaggttgcagtgaaccaagatcatgccattgcactccaacctgggtgacagaggaagactctgtctcaaaaaaaaaaaataaataaaaattcctggaaatggattagcttgctgacaagagttattccattgtgtgtttctacctgcaatacctgaggatgcccattttctcacgatttataaactaactcattttatagatgtaattttcatacatttgggggtatcgttctaacttcattattattacttcaaggtgttattatttccccatcatcatcatggtcattatcataactagttggtgctgacagtagtcaccctgcattgagaactcatgctccaggccctttccacatagacttgatttaattccattcactcctcacaacaatcgtctgaaagaaagaatcactaagccattgtataattgaaacacaagaggcgagtgacttgtgtgcccttgggcaggtaatttaaacactctgtgcccccaagttccaatagataaatgtaaataataatatctttcttacctaatacatggggtcaacagttaaagtactgtacatttgtgaggtatttcatggcacctgtgaattgctcatgtgatgacttagtgtgcttccagtgtcagtgtgctgggaaggagacagaataagaagaagactgaaaagatgccgagtctagtgcagggtatcctggggaaaacacctcctgtttgtccaacagcgattggccacacattgaagacacactacctggctgtgaactggggtgaccctgttgaaatcttgtggaaagcttgagatgctccttagagggtgtttatccctcgagctggcacaaatgcggtttgttgttcagtttttccttctactctgcctctatctggtacaaaatggaattgaagaggatataaaccagcaaggaacaatctgaaatcagaatggtgacaatgggagaaagtaatcttggttcaacccaatgttcacctgaagtctctttattaaagactactaacaggaacgaaattgcataataatcttcctatgataatttcaagttccagaatttctctatggaactttcaaatttcacctctgttaactcatggaattttccctagaatctgcaaattaccgaagtctttggaggtttgatgatcactcactggtcagcggtactacaaaaggattctggggagtttgactcagtggtcagcaaaggctcttccgaatcttcagtctgattctgagattccccggggagaactggagcctttcttaacagctgttgattggaaagaccacctgcttcatcctctattgcaacagaaatagccattgtgaatctccatggggaggcacaatgagttttttctagcatgtgtgactcaggtcattttgttccgtggtttccagttgtggggacttggcaaggtcacaccctcccctgagcctcagtttcatcgctcagaaaatgaggataacaattctacttgcctcataggattgttgtgaagattaaatgagacatgtaaacatttgcttatagtaatttcacaccactttattgtggaatcaaagacagaattcttacagaggtcttggttagttaagaaaacatccattcaaagatttgattcacaggacaccctcactgtctttctctcttttttttttttttttttttttttttttgagacagggtctcacttcattgcccaggctggaatgcagtggtgtgatctcagctcactgcaacctctgcctcccaggctcaagagattctcccacctcagcctccgagtagctgggattacagccatgcactgccactcctgggtaatttttgtatattttgtagagacggggttttgtcatggtgcccaggttggtcttgaactcctgggttcaagcaatccacccgcctcagccacccaaagtactgggattacaggcgtgagtcaccacacctggcccttgcttactttcgtacttcccaagaggcaggttaccaaattggtgaaattaaccataacatcattgtgatgggcaagcagatatattaaaagcaaagatacagcaggttaacattaaattttgctcatcccaggacaaacctggccacaggaggcctttgccagtattctgaaaagtgttgtgaccatctcctttaaagctcagttaaaggtttctggctggactccaggctgcttcaagctctttacttgtctttatcattctttaaggagggacccagacacagtatgcagaggcctgaatcctctagatcattctctctccaccatgagtcctgccgtggggacttttccagctccctttggccttatgagccagaaaatcaggctagagcctaaagagaacagaaatttcagaatcaggcttgttctgcgactgtatgggggagctgaaggacacaatgggctttctatattggagactacccatcatactctctctgcccagggagaaaggacagatgctgtgtgattttgcagtctgtgatttggcttctcattctcgctgctctctacacctcattgtttacttcactcccctgaaaaaaatgctccctaacaggctcagtacccaacttctgggtattgctgcccacatttgccttggttctaccttttcagattgcaggatcctgaggttttgcttggagcagctcagattctccactagatctaagatctcacctagtcctgaggatttccttaaagggaaggggaaagatagatagatagatagatagatagatagatagatagatagatagatagatagatagatagttgctgcctttgctctacagcatctgcttggtgaagaggctcaggatctggatcctggcctctcagctctcaggaaccccattcccccctgacaggggtggcaagttcatcctattattcattaagaaatttgaaaacaatcattcaggaattttaggtcaagagctggaaaaccccaagcctccatcacctgagcaaagggagatactgtgagcacctgcaggatacacccatgttccaccacctgcctgaagaagcctgtggttcttgtcagcttctcaagggtgaagtgcagatccttttctgcttgagcagaagagcagaccaaagagctcattgactcaaggagcatcacggcaactgagctgcacctggaagagaagaatccagggtgtgatccacagccaaggcctgaagcaatggggcccatacttggcctctccagggtgagttgtgacccaagtgctgggctttagcccatgagtggtccctcttgccatttccagtttcctcccaaagagaggccagtgttggtgatttcatttcttataatctccttaggagcacaggttttggtttgtgccttttttggatcaggttccctgcattgcagctgctataattaaaactattaacaacaacacagcaccacagaagcaagttagttgctaatggaatttgctgataatgctgtcttctagagaccactctagtaactggagagccttggtgtagagctgatgataaaacctattcctgcttttgtcagtcatgaggagcatttcctttctagacagaggaactgaaacccacatgccagcccaaatttaccaaaagcagtcactggaatactcatcacaccatcatgtctcatcttatccctttcgttaccttcaaatacggccccgtttcctcaggaccagaactcccttatgtgggcagcaggactaaggcccttgagttacctgtggtgactcctcattaaatggaggaatgtgccagtattttcagcaaaacatgaatctgatgaaacactgactgaactgtctcctagtttcaaaacaaattattaccactcagggcctctatttagggcaatcagagtcagaagtgggaacgcatcttgtcctcctaccttgattaacagtaactctaattgcaggatgatggtcaaatcctctctcctctaatgtgcagttgtgaaggatttaggctccactgctcatgcatttgggtggggcctgaatcactttcagtctagcacaggcgggtcacttcaggccttcccacctccatcagcatccttcaatcctcccctgacatctctcatttatgcttcctattgattcagaggtcccaacccgagtggctaaaagaaacattcattaacctttctacaaagtcatgaataatccatggattacattgaattcatccctactaaaaccatcttcagaaattcagatgtagtaaccttctttctgaatttttttttttttttttttttgagatggagtcttgctctgtcgcccaggctggagtgcagtggcatgatctcagctcactgcaagctccacctcccgggttcacgacattctcctgcctcagcctcccaagtagctgggactacaggcacccgccaccatgcccggctaattttttgtattttgtttagtagagacggggtttcactgtgttagccaggatgatctcgatctcctgacctcatgatccgcccacctcggcctcccaaagtgctgggattacaggcataagctaccgtgcccagccaagtattctatccttaatgaacacatatatgcacattatatctattttttataatatatatatttagaattgaatgtcagagtacatatcagtgttggaggaagagaataaggaggaagcacagaaagtaaaaaggaaaaataggcaccaaaaaagatttggagaatggcagatggccaaggagatgcagttgggaagtgcctcttccatggagaggaacccaaatatctagtaaaccttcacattttaaacagatcttttgagagaaaacactgaaagttgacacagaggtgacacagacaccatggttgaagagggaagaaatgggacagtctgctcagagtcactagacatcaggactggcccatataccctgaacaaacccaaggaaggggtgagtgaaggaaccctgggacactacatacccataatgtacctctgagatcctagttacaggagtttctacgaccctcatagatctttggactggtaggagagctgcctcgagcacatgcagaggcacagtttgaacccacacagagcccagaaggctttgttgtgctgtgcagctgcagcaaaatgcaaccctaggtgcccatccctcaagcctccatttcatactgagtggctaagttcctgctgtccgccaggctgggagtgaaccacgcctggcctgctcacatgcccaagataggccccatcaccagtgctgtgtgattaagttgcatctggtccacatgcccccttgcctgtcaaccccttcccagagctcatgcctggtcacgcctgcaagagggtgtccacagcacagcatccactgcatagcttgagtgttttgttgacagcctgggaaaagctcaccaccctgtccccaagtcacagccagtgcttgaagcttagaggccagaggacaaatccgtgagcccagtcccaactccccaagactcaagtataccacccagggacactgagctgagatttgtaacctaatctcaagtgaaggaggatcctccatagtcagaatgcagagaagggtgtggtatgggttctcatgggggcatgggaactggacacccctccctttgcaagaccagaccatgaagggtatggcctgatggtggtagcttctttcccagggagtgtcctggcacagaatgcctggagcagctcaacaatgtgggagcagatggcttggggaaagcctagttggttgggcttgccgccagggcgagtgtctgtgggagatctgctgggtcaggggagtgtaagctaggcagactccatggttgcctgctgggctgaaaatcatgggctgcagactccatactggtgttgcacccattgtgccactgccctgcctggagatcctctacccttgaaatactgcatcatcagagcaactgcagacataccctaaaacctgctctgactttggtaagcacagtggactggtgggtctctggagagttgtgtgtccctagagatgtaatcctcagtgtggaccatccctaagggaagggggagtgcagcctgccaaagcacaacatgagacaaagaaaatgcggccatggcataagccactgaaaggagcaccaccaaggcccagaaccagacttggagaaggaattatgtctcgcctccatctcccctccccagtgcactgttgcagatgcaacaatagctcttcccataggggcccagaaagcgtgcactgaaagaagttgtttctcatgattctccagtgagggcaagcatgcaccaagaccccacctgccagctcttactcttaagtccatctaccagactgaagtttgagttataccatcatataaaaatacattgctaaaacaagcaacatctgtgaaagccactgcagcaacctatctgtaaccaaggaacatatatggaaacttcaccctctgcaactacagagaaatgaagccaatcaatcacatacaccactgtcatactttcaaagagaataaaaaatataaaagccctgtgatggttaatactgagtgtcaacttgattgtattaaagggtgcaaaatattgttcccgggtgtgtttggagggtgttgccaaaggagattaacatttgagtctggactaggagaggcagaaccaccctcaatctgggtgggcaccatctaatcagctgccagcacggctaggacaaagcaggcaggagaaggcagaagagcagacttgctgagtctcctggctttcatctttatcctgtgctggatgcttccagttcttcagcttttggactcttggacttacaccagtggtttgccaggggctctcaggccttcagccacagactgaaggctgcactgtcagcttccctacttttgaggttttgggactcggactggcttccctgctcctcagcttgcagatggtttattgtgggactttaccttgtgatcgtgtgagtcaatgatccttaataaactccccttcaaatgtacatctatcctattacttcggtacctatagagaactctgactaatacaaaccccatctaaatgaagcaaattcaaaaaagaagtgtcaactcccgcagatggaaaggaataagcacaagaagtctggcaatacacaaagccagagtgttttgtgatctccaaagcctctcactagctccctaggaaaggatcctgaccagatgtaaatgtctgaaatgagacacatagaactcagaagatggatgtcaatgaaagtcaatgagacataagacaaaatagaaatccaatgcaaagaaaccagaaaaacagtccaagatttgaaagacaacatagttatattaagaaagagccaaactgaacttctggaactgaaaaattcactaaataaatttcaaaatatagttgggagacttaaaaacagactaggccaagcagaaggaaacacttcaaagcttgaagactgattcttcaaattaacccagtcatgcaaaaataaagaaaaaatattttttaaaaagacaaagccttcaagaaatatgggattatgtaaagaaaccacttctacaacttattggtattcctgagagaaaagaaagagtaaccaacttggaaaacatatctgaggaaaaaattcaagaaaatattctcaattttgctagagatgttgacatgcatacaccagaaatccagagaacctctgttatacactataaagacagccatccccaagacacatagtcgttagactatccaaggttaacacaaaagaaaaaacaaatctcagacacagctagagaaaagagcaacactacctacaaagggaacccatcagactaacagtggacttctcagaagaaaccttacaatccagcagagattagaggtctatttttagtactctaaaaggaatgacattccagcataaacattcatattcttcaaaactaagcttcataaacgaaggagaaattgagtctttctgagtcaagcaatcggtaagggaatttatcaccactagactagccctgcagaaatgcttaagggagttctaaatgtggacatgaaagaacaatacacagaaaaagcacagttaagtacatagtccacagactctataaagcaactacacaattgagactgcaaagaaactagctaacaaaactatgacaggaacacaatctcacatatcaatgttaaccttgaacataaatggcctaaatcctccgcttaaaagacatacagtggcgaattggaataaaaaaatcagaatcacccatctgctgtcttcaagagacccatctcacaactaatgacactcatgggttcaaagtaaagggatagagaaagattaatcatgcaaatggaaaacataaaagagcaggagtttctattctcatatcagagaaaacagatcttcagccaaaaacagaaacaaggacaaaattgttattgcttaatgacaaagggctcaattcaataagaataattaactatcttaaataaatatgcacccaatattaattggagcatcacgatacataaagaaatcactactagacctaagaggtagacagcccctcagtaataactgggaacttcaacactccactgacagtggtagatagattattgaggcagaaatctaaacaaataaattctggacttaaatttgccacttgaccaattgaacctaatagacatctacagaatactctacccaacaaccacaatatatatatttttttctcatcttcacatggaacatactctaagagtgatcacatatgcagttataaagcaagtgtcaagaaataaaaacaatcaaataatatcaagcatcttcttggaccgcagtagaataaaaataaaaatcaatagcaagaggaactctaaaacacagacactcacacacaaacacacacggaaactaaagaaattactcttgaatgacttttgtttgggtaaacaataaaattaaagcagaaatcaaagaattttttaaacaaatgaaaatagagacacaatgaacaaaaacctctgggatgcaataatagcagtttaaaaaggaaagattatagtgctaaatacctacatcaaaaagatagaaatatctcaaattaacaatctaacattgcacccagagcaagtagtaaaacaagaaaaaaaactacatccaaatatagcataagaaaagaaataacaaaaataagaacaggactgaataaaatcgagactcaaaaatccacacaaaggatcaacaaaatgaaaagttggttctttgaaagtgtaaccaaaattgatagactgcaagcaagattaacaaaaaagaaaagatccaaataagcacaatcagcaataacaaaggcgacattcaatcgagtcccacggagattcaaaagattctcagagactactatgaacatttctatgtgcacaactagataacctagaagaaatgaatacgttcctggaaacacacaacttcccaagattgaaccaggaagaacctgaaacactgaacagaccaacaatgaattacagaatgaattgaataagtaatagaagcctaggactagatgaattcatagctgaattctaccagacatacaaaggggagctcatgccaatcctactgaaactattccaaaaaatcgaggatgagagattctcctctaacttactctacaaaacctatatcatcctgataccaaaatatggcaaatactcacacaaaaaacaaaaccctaggccaatatatctgatgaacatagatgaaaaaatcctcaacaaagtacttgcaaaccacattcagcagcacatcaaaaagataatacaatatcaagtgaactttatacctgggatgtaagagttgttcaaatatatgcaaatcagttaatgtgattcaccacataaacagaatttaaaatgaaaaaaaacataagattatctcaacagatgcaggtaaaacatttgataaaatccaacatgccttcataattaaaaccctcaatagactaggcattcaaagaacatacctaaaataataagaaccatctattgacaaacctagtctacgttatactaaacaggcaaaagttggaagaattcccataagaataagaacaagacaagaatatccactttcaccactcttattcaacttaatactggaagccctagccagaatgatcagacaaaagcaagaaacaaaaggcatccaaataggaaaagaggaaattaaattttatttcttcactgatgataggattctatacctagaaaaccctaatgattctgaccaaagactcctagagttgattaaaaatttcagtaaagttttaagataagaaatcaatatacaaaaagcagtagtatttctatacaatgcaatattcaaactgagaaccaaatcaagaacacaatcccatttacaagagccacaggaaaaaaaaaaaaaaagaaatacttaggaatacctctatccaaggaggtaaaagatctctttaagtagaactacaaaacactgctgaatgaaatcatagatgacacaaacaaatggaaaaatattacatgcttatggattggaagaatcaacatcattaaaatgtctttactgcccaaagcaatctacaaattcaatgcagttcctatcaaactgccaaagttatttttacacagaattagaaaatcaattctaaaatttgtatttaactaaaaaagagcctgaatagccaaagcaatcttaagctaaaagaacaaaggcaggggcaacacattacctgacttcaaactatactacaaggctacaataaccaaaatagcatggtttgggtacaaaaacagacacatagaccaatggaacaaaatagagaatccagaaatgaagtcccatacctacaaccaactgatctttaacaaaattgataaaaatacaatggggcaaggataccctattcaattaatggtgctgggaaaactggctaaccatattcagaagaatgaaattagactcctgtctctcaccatataaaaaaattaactcaagattgattaaagacttaaatgtaaaactttagactataagaagcctagaattagacctaagaagctcttttggatattggcctatgcaaagaatttatgactaagtactaaaacacaaaagcaacaaaaacaaaagttgacaagtgagaccaaattaaactaaagagcttctgcacacttgcatgttatattgcaaatatgaaatagcaaagacatggaatcaacattggtttccaacaatggtggattggataaagaaactatgatgcatatacaccatggaatactatgtagccagaagaaagaatgaaatcctttcctttgcagtaacatagatgtgcctggatgccatcatcctaaatgaattaagatgtaaacagaaaaccaaatactgcatgtcctcacttataggtgagagctaaactttgggtacacaggagcaaaaggatggaaataacagacactggggactccaaaacaggggaaggaaggaaggcaaggtttgaaaagctacttattgggtactatgtttactattcagataatatgttcaatagaagcccaaacctcagcatcatgcaatatattcatgtaacaaatgtacacatgcatgcttaatctaaaataaatattaaataatcaaataaaatgatttccatgaataaaacggtagatatgattatgtggaaaatgctttactatttattatgtggtgaataatttaataatatttaataaatacatgaatgaaaaatagctacaactgtgtgttaggatttcaataattttttatttcattcctataacttttatgtattattatatacataataatatatagttaataataacaaaaacaacatggtattgaaataatttccacccagaaggaggatcaacatatttaagtgactacactactcgagataaaaatcatttatcaaacagatcaaagtcatttacctgctttcctttttataggtcctaggaacacacgtgccatagacaataaaacatcacttcccccatcccactaccttggactttatttaacatctttgggtagaacagaaactgttgataaggtgagttttgttttatagacaagagaggaaaatggatactttttgtggtctgggccttagaaacagactaagatcttttttttttcttttttgctttttttactagcataaaatattaattggcaaaacaccgaatacaagcttcactatcataaaatcaaaacatttaagcaatattccaaaaaagatttgacaaaaactagtcaccaagagtacaaaaattacacatcaacacaaagcataaaaaatgtgaactttcaaattaaacagtcaaaaacatgtacctgcgtgatcacctccacaccttgactgccttcgtctgcagcacgctgctggtaaaggctgggtggctgcaccgtcgtcccctaacccaacattgctttcatctgggaaaattcgcttgatagccaattaagccatggaggctattacatttacacggggctacgcacaatctcaggggacgctcaaacagcagttcgttcctcacacgcactgttgggtgcaaagggcacctggagagtgagggagacctgggcgctttcctgcggggccttggccacgcggccgtcgcccgcaccctgtcccttgcctggcaggggacacaatatttgtacagattatggtataatttgaatgattttctaatctacttatcttaatttatatagtttatttaaatgtcaaggcagagaaatacattgatcatgttaaggtcacgtgatgtggtggcgcagtaatgacttcctgaggaaacagaaatcggatgttttgtgatttagctatgtgcactaaacttattttccatgttttgagagcacattaaacattcacgtacaatgtgggaataggctggctcgtaaccaaaacgtccaacccaatgccaccctttgaatcgctgtgaacaccgtcctattgcggttcagagaaaacaagcaaggctgcgaagccccggggttcaggcagctgcagcgcttgggccaaggtagctccgctctctggtctgaagccacgtggccccaccccggggcggcctggcttttttatagtgcttattgctgtgtttggcatgccattcaacccatcgggatgttggatagtgacttgagagcaatccctagatttgccctgtcgggatgttgcatactgagttcggaataagccctgctcaactgaggcactatcactaggaggaggcactgattcccgcctttcaatgctatctattggtgaaagaggagttggatggcatctgggaaattagtatcacttctactttttcttcttttcttttaaaggttaaaaataccttgtattagttaatactgctataaaatatgaatatccaaatctctgtggctcagtaaaatagatttttttttcactcagagaaagttcaggttcacccttagtaacccaggctgacagagactcttccattttctatacatagcttccccaattgcccagagaagagtggaaagatttgataggtgactgtacacaagaataagaacttagtacctagtcactaatttactcgttgaataaacatttatggagcttaacatattaatcactgggcagacgctgggacacaagaaaaatctttaagatatgtcactgcttattaccaataatgttctagtgagtaacaagagttaataacacgactaattatagtattgtaaatataattacagttccaataagacatacacacacacagaacgattttgtctggttgttgaggaaatctttattgatttaagatatcttttgatgaacaggatttttcaataactatcagaaaaagaatgtctatgacttatttttaaaaactattttcttatctgccttgcatatctgacactttcatctcctatcttccttgaatacaatatagaacctgacatttctttcctttcaaagatccttagagcatttcctacatttaatctgaatgtctttctcagtaatttttcccatacaagcaattatggctacattttcttaatataatcatgaaaaggtgagcaaaactgaaaatttaatttggagaatagatacgaaacattcaattaattcaagttgttgttaggctgcatatgttcagctttcagtgaagatgaacaaatgatgataaatgagaaactgaaagaaaacaaaccaataggtgttttttaagaaacaatattattaaagtgcatgtgttttctactgaatgaaagcaacatagaccttttcctcacattggtagttagtaagatgtataaaaacaactttgtaaagaacaattaatacaggttaatgaatcattgtgaaaaggggataacacactttattgtagcaatgatctgcaaggtgttaaatgttaaaaaagatgaagaacaattgagtagttatttgatcacagtgtttattaaattgcttttcctgtatctggcaagctttacagaaatgtcttcaacagaataactgtgttaaaagccaaatgaaatgcattttgaaatatgattcttcacttggtgtgcaggtataatctcaggtgtaattcagacaagagacaaattcaattttaaagttccatttgttacaatttgatgattgtgattaaagaaccataaaaattttatctttgacatttcattttttcctcacaaaagtattctactgcaattttcttagttttctttcctcttaactgtggtgttacctataaatgctggatttctctgttttacgtgcaacaaatctacaatcaactatttctggaacgccacttcattttaacaacaaggacccataaatattttaaaaattcaaaatgttatatataaaatgttaaatgatacacataatacatttctaagtagtaattatgattatgcccataattatacccataatttaaaaatatgttacctgaagtaaattattatacgttttatgttggaagtgttcatttatctttgatctctgttaacacattgtactatgtggtaataatataaactgccttactggatagtgatgtatctttggtttcatattgttactggactaatattccaacactatagatagtgaaatttaacattgaaacaatttgataatgccatcaatgaatccagtttttaagagtgggatccattttctaaaattgagtatatagatacttcatgagatatcttatcatgcatcctaaaccaaaccaacctcttcccctgactgtcttacagtgtattattattattttatccaccacagcaactagtacatttttcagaacctagtagatattcagtcattgtctatggaatacatgaacacattctgaatttggacagtcatcattcttggtgttttaaaacaaacacttcctgaattgcatccactattttctaagaagccctaggaattcattgaaggagggtatgggtaagttgtgggtgaaactgtaaagatgtaggtcctcctcccaaaacttcttcagcgtatcttcattgctgtttgtttgcttgcttgcttgcttattttaaaagagatctagatatagtctaataagaattgtataaatgtgatgttccacaatgattctaacttacatggtgcaaaataataaaatattacattctacctgtttgtagaaaaccatggatactataaaggatctagattttctctctcctttccttctaagatttattcactcagcaaagacttacctggtgactacttagtgctagacactgttttagatacttgggctataacagtgaaaagaacagtaattgaattaatgaaaagttcattttaattagctgtatggtaaaataggaaactaacaaaaataaaatataacatgtcaaatggcaatgactgctctgagaaaaataaaggagaataagaggttctaaattattatatacggccaatattaccaacatattatagaaagaaatgagttcataatgtttatcagagaattccatgaaaatcgctaaatttttctagaaagccaggcactgataagagaataaacaaacagataactgattttaatttgatcttctcttacaggtgcagctatgatctgccattgtatataatataaaattaaaaattgtttatatttcattcacgttagcatataatgttcttacttttttttttttttgagacggagtcttgctctgtcacctaggttgaagcacagtggcacggtctcagctcactacaacctccacttcccgggttcaagtgattctcctgctccagcctcccaagtagctgggactacaggcaggcaccaccaagcctggctaatttttgtattttattagagacggggtttcaccaaattggccaggctggttttgaactcctgacctcagatgatctgcctgtgcctcggactccaatagtgctgggattacaggcgtgagccacagtgcccggccaacgtttttacatttaaatatcagacatctatcatattcctttctccctactacaaacattgtatgcttttcaataggcataagattttgttttcactcaggttggattcaacaggtattatttagcagttcattgcatctatccatttacccaatagaggaagtatacaagatacaaatgaataaagtgtaataattcttatactatttgcccttatgtcatgtaactgctccatgtttgtattccgaaaacctaactgggagggaaaactcagaaaaatagaataaaaagtattatatatctcatacatcctcatttttgaatattctaggggtacagatcagtataaataaaatactctggtaagtgaccaccacatcatctgtttgtcattcttagacccagagtataccattcttttaagaaagaaaacttgctactgtacctgctacccagtaacatatatatcacatatcatatatatatcataacatatatatcatatatcatatatacacatatcatatatctcatatatataacatatttgctactggttaggagtaacactcagaaaattatacttaataatgtagtacaattaggtataaattcacttagtatttttaaattttacgtatattcctatttatatgaatcgtcatttaaaatcacatctactgatcctgatagcattaaaggcataagaggtactgaggatattaatttaattttgtttacagctatgcacagatatttttagttcactgagatttaatccagtagtctattatttgattaattgtacagctatcaaatcattcaggactcccactgtttcaacaacgagagtggaaaaatattttttcatttatgtttatatgcagctatttgtagtctaaattaatatcctagcaattgatggtgaaattaaaattatttctgtcagatgtggtactttgatgacagtggataagcatgggaataaaagaaagttttgaggaagaggggacagtttttgtttacttaatgattattccaaagatgttaagtaaacattctatagaatgcaacatatagtggaatacagcattgaaacaatttaataatgtagtcaatgaatccagtttttagaaatgggatccattttctaaaactgagcatacagatacttcatgagatgctttatcactcatcctaaaccaaaccaactccttcccttgactgtcttgcagtgcatagggcatctctacactctaggaaaggaattatcaatctgtttatatgccacttataaaatcatacttaatgtacgattaggcataaatttacttgcatttttaaattttgtaaaatgttaacggaaagtgttcttgaaaaacatttctgagaattccaaaaaatgaacaaattttaatacataagggacaatatctttctagtgaattgattatcagagtgtaatgtggtatgttctgattatgttacataatattctgattagcagaaaattttgaataagtgaatttagcaaaatgtttagaggtcaagaaaactgttttagactgactatgttttctgacccaaatgtaagaaagaacccaataaaaagaggcagccagataatgctgttgtttgcaaacttaaacagaagcttgcatgtaatttatgactcaaagaaaaataaaaatagaagttatactttatttagaacttaatgacagtgaaaaattgcacataaaaaggaagactgttgaatacagcaaaagctggaattatataagaaatataaacataaacacacaaaataagtgtaaattataatgaagtaaaaatatatcaaagagaaagaaggaagcagtacaataaaaaataaagttgattctttaaaaaccatagttaaatagacaaatttccagccagattgtttaccaagtaaagagaaaaagaaggagatagatcaaaagacacaagatgatgatgaaaagagggtcagcacttataaacatagtagaaatttaagccataatgagcacaagaaagcattatcaacttacttttgaatatataaaatagacacttaaaaaactgaacaaaaatgacttactagttttaaaagaaaaaaaaaacatcaaacatctatccttccaaaagtatagacttcaaaagtatagtcccagaagggtgaacataaaccacactttaagcaagaactctcagttataaccagatgggtgaacataaaccacactttaagcaagaactctcagttataaccagatgggtgaacataaaccacactttaagcaagaactctcagttataaccagatgggtgaacataaaccacactttaagcaagaactctcagttataaccacatgggtgaacataaaccacactttaagcaagaactctcagttataaccagatgggtgaacataaaccacactttaagcaagaactctcagttataaccagatgggtgaacataaaccacactttaagcaagaactctcagttataactgcttgcagttttagaggatcccagccacactcctgaaccagagcttggcactgggtattccctctggaacacccttttatttccttctctaagcaaagacatggaatcaacctaaatgcccatcagtggtctgctggataaagaaaatgtggtatataaacaccatggaatactatgcagacataaaaaaagaacaagatcttgttctttgcagggatgtggatgtagttagagaccattatccttagcaaactaacacaggaacagaagatcaaacactgcatgttctcactcataggtgggagctaaatgatgagaacacacggacacatagagtgggggacaacacacactggggccttttggagggtggagaattggaggagggagaagatacaaaagaataactagtggttactaggcttaatactggggtgatgaaataatctgtacaacaaaccaccatgatacaagtttacctatgtaatgaacctgcacttgtacccctgaacttaaaagttaaaaatgaatgaagcctgtcagaaccacccatttagcagtctaacattttgcctagtattcccaaatccctttgcctagccaacatttttcacagcactttttgtcttcaaactactggcctgaagcaatctggcttagctttctgagtagctggaattgcaggtgtaccagtgtgcccagccacagttttttcaagacctgtttaagacaacaggttagagaaaatcaagataatattttgagggggaagaaggtaaaatcaattaagacagggtgcacagagtacttgaatggtacagataatgtttatcctttgtactaaatggtgtgtatgtgggaattggttatattattttgactgtttgtagtcatattatatacatatgtgtataaataaaaataaaagaaaaaatataagctaaatttatagatatattaattttatttaaatataacaaagatttgccagtattcaaatgtctgcaatgattcttaaaatgcacagaacctgtgtttaggtacagtatcactgttcatccagccttcattcactcgaatctactcttacctaaaatttgtaccgtaagtaaattacattctgtatgacagaaagcaaattacaatattagaacaacattatggaaaattggcataacattgtacaatcatccattactttattatttatcattttgcaaatttttattatattagtaaaaaagtctaactgtacttaatagctaatacatatattatttgatatttttaaagaccattattaaaataataataatttgggggtgagaaggcctattgaaaaatgaccaacgtggaaatcataaataagtttgatgcaacaaatatttgtgagtcttatagttaaaaatgtaaaaattcattataaacaaagctaaaagacaataatatgcattgggaaatatttgcaacatttacttcaaaggtggatgtccttaagagaatttttacaaattaataaacatttaaaaaggtgaggagtggcaatagctatgagagacaatttacaaaaacataaaaaatatgaaaactgtttaatctgtaagtacatcaataaaaattttattattgtagttattttatctattaaattaggaaaggtcaatacaattggtaatcttccaagtaaatataggagagaaggtctttctcatacatttataagaatattattttgttagaatgcaattaaataaacacttggtaaaaatccatatcctttgtccaaacaatttaagttctagacctctagaatccacatgtacatatacatatatacatacatatacacacacacattcacacctatatattaacaactcaaatccaactccaactcttttgtaagtagtattttgtccaacaaataaatttatctcaaattcttcttgacttttctccattatagagccagcaattctacgtgtaactctacctctaattcctttatttgcatttatttctgctttcaaacccttatatgaggcaagtgggattaatttatttcattaccttaactagattcatcgctttactttgtcaaactctgattgatttgctcaactcaatcttatgtgttcaagaacttaatgtggattcctgttccaccttatgaaagtcttttccaaaaacttgctaaattcttgactcaagacattgcagtcagtaatgcatttctctcctcaaatacaatggaactgtgttctaataaatactcttcaacaatgtgcagttatttctccacaactatcaattccccttaaagcagaattttactaaaaatggctttatccttctggggataatcagtaaaatggcaattggtgggtgaattaaaaatatactaaaagcagatggcagaacatgagtgcagatttttactacaaagcttaggaaaagcaaaaggaacttgaatagagaaaatgcagaaaagccctcctttggctattaggacggagagagcagaagtatgtttagagcttcaaagagtctgactctttgcaactgtttatcttaggactttaaggaagtaaaaggtgcaagtgaaacactctggattataaaatagaatctgacacagaggattcaacccagttaatatgcatgttgcttacatggaaatgctgagaaatttttagcaaatagatagaaaatgacagatggtaggtatatagaaaataattgtaggaaaaaatgtaaaatgaagatttatggtattccttttatattttattttgttaatatgttgcccataatgctttatttcaaagaatgcaaaaccaaaaaagtagttccttcctaacttcccctgcagccttgtcttgtggagcttgtattttacttcatgagaaatgccaaggagatgtcatttaagctgaaacctccagcagaattagccacaatatttgggaaaaagatgtttccagaaaaagaaagagctagtataaatgtccttaggcaagaaagagctcacgatgattgaggaacaacaacaaaaaagattatttcactcaagaaaagtgaattgggagtacagatacaaatgatgaggtctgaatatgattcatggggcaggtcacactagggtgtttgggtatggtctaaatgaatgcgcggcatgagttgctttaaggagaggagtgacatgatttgacaagttcttaagagatccctttgattactctggggagaatagaacataaagtagcagaaatgaaagcaaagggagatagtaggaaataattgcacatttataagcaagaaatgatgttggcttggactctggttatagcaacaaataaagaaaaaaggaaatactgagaagagttgattggatttgctgacattctcaacataaatggaagtcagtatttttttctaataaatataatatgcgtaaatatttttaaatatttaattcttttaccactaatggggcacgagtagacttcagggaacatgccagtacagaaccatataaatgtgatcattggtagagataggaattaataggcatttgaatgtctccctcaacctggaataccacaaataaagctctttgcttttcatgttgcattgttatcataccctatagttttctgccattttcagttacttaatattatgttttgcctcaatagattatagtgctttctcttgttgtgttatatttgcagcaattattagtgaagttttaaacttcaatatcacatctaaaacagagcaaaattgttgcatactattttccattaaaacatgagaccactatgacaaaaaaagctaaacgtgtcatgaaatgacttacattggatgaaagtatatgcaatatattaagaaataatctctgactttatagttttttatttgtagtttttactagaacgtgaaatcaatatgtgaaccctggctggagtttgcatctaaatgtaataaaataaaagaaagtttaatattatcattgaagcattaatgtacattagcgagctggactatataaaataaactttattatatttagcatttgatttttatttatgtatattataaaatgaatatagtttatattataataaaaataaaagaagtagtatgttaactaattagtataagatgcctacaaactacatatctgcctaaatttttgacccatgaaacttcaatgatttgtgttaatgttaaggcctacatttatttatatatatatataattaggggaggaattgttaattctttcattttaaaaattttaactttgcagacaaagttgactatacctgtggcagaacactgcaacagctataaataaataaataaataaataaataaataaataaataacttttattttctgtggagctcccagaattatgaattattctgtagattgagatttgccaaggtccttttcttagagttgcaagagcataggagaaagtcaagggaaataataagcagcacttgatttcctttaccacagtggatgggcttctaaaaccaaattacctgactataaatccagatctatcttctgcaggctatgtgattgtggatgttacctcttctgtgcttcaatttcctcatctgtaaaatggaattatagcctaccctattttgtagtatagtgaggataaatagaatgaatgtatgtagttcttagaatagagcatggcacgtgataagtggtcaataaaatattgtttactactagttatgtaacagtcacttcacacataataatgatttaataaaggaataagaagaatgtagagcacagcttctcaacattggcactatgacattttgggtcagacaattatttaatgcagagggggctataggatgcttagcagtgtctctggccagtagtgtacctcctcctctccaagttttgacaatcacaaaggcttctagacattgacaactatcccctgaaaagtaaaattgtccctgcttgagaacacaaatataaagtaaccactcaaagattacattactaattttaattgaatttgaccagcattatgaaataagcataagcttaagtttctacccttgattttgtcattgtcagttagggcagcagagaactccaattctgaaaattctgaacatgtgctaataccctataatataatcaaaactttcatttttgaattgtatttcttaaaaattagaaaatttattaagcagcaacatggaataattaaccacaaaaatgttgaacataaatctcatttgcctaagttctcttttgaagtcctgtttcactatataagtattatgtgttttgtttcacagctagataacagccagttttttctctgagcctaaggttgctcctcaaatttatggtggcttatagctcttctaagtttctataaaacttcagcaacctgcagcaggttgaaatttattgatattgagttattcaccaggtcatattacaaagtcagggactgactcacccaaaccagatgctccccctgccaccagatcactaggagatattgcaatcatttcccctggctactaaattagcaaaaattctcagggagagagaagggcaagatggcacagtttaatacttactattattcttttattctttatcatcattccctttgaatggattaagaatctgacataaatataacttgctaaagaaagggtgttaggtgagagggaagtcatattggtctaagaaaagtcttagagaaatatttgaaaagaggtagagagaagggttggattggagtgggtgggtggggaatcacactaaggagatggatcattcataatttctttagacatggtgaggcagccacaggagtctgaacttgttgaaaccctagtctgaagccaataaaagtgctcaataaggtcacactttgatcttctctgcctaaagcagttattcaccctatctttgggagaggaaacatctacaaacctttgttctctttgttagcagagggatgacatgaatttgggaaaaacgtttgagagacaaaatgagatttagctcgagcaagtgatcgacttgtgctgggttgcaaatggactttttcaacaggcaggttgaaactgtgcttcagcaattaggataccagatataaacatccatgcacagaattggaaaggttcagctttcatggttgctatggtttgaatgttccctccaaaactcatgttgaaacttaatccaaaatatgacaatatagagaacgagctttttaaagaggggattggatcatgaaagttcttccctcatgagtggattaatccattgataagtcagtggattaataggttatcttgggagggaaaccattagatttataagaaggggaagatagacctgagctagcatgttagcatactcagccctcttgccatatgataccctgtgctaccttgggactcttctgagagtccccacaagcaagaaggctctcaaaagatatgccccatcgaccttggatttccaagccttcttagctgtagaaaataaattcagttctttgtaaattactcagttttaggtatactgctataagcaacagaaaatggactaagacaatggtcttatccagaactttgtaaactagaattggctgtttagattcagtatgtattttttttatagattcaaaataattttgttttgaactgtacaatgaaggagtgtcataagcttttccacatgtagaggctctaaatatcagtctggcattgtgataaagcagagagtttaaacccaatcctatttgtgccccatgaccgttctttctggttacagttcagaaaagtaggaatggatgtgtaactcaaggagaagcatacaatacatgaagctttttctcaaaattttgatttagaaaatgaggtattttagtatgttaattataggcatctcaactgagaagtctaatagcattgggccagaattgtcgcagcagtccaaagccatggataaacttaagttaaagggagcaaatactaacagccttccaaattaatctgtattggagaagatgataaacagatgaatgggaactagaaaccatgcagacttggaactagatataaaacaaacagctatctaatgatttcttatttactctgagcccaagatatttttgtatccttttagttaaacctctgttttactaaggaaatttaaataagattctgtctcttgcaagaaaataacatctaagacatcttcgtatttaatactgccttaattttgtttactccagtggtccccaacctctttggtaccagggattcgtttcgtggaagacaatatttccatggacagggttggggggaaggtttcgggataaaactgctccactactcagatcatcaagcactagattctcacaaggatcaaactagatcacttgcatgcgcagttcacagtagagctggtgcttctgtgagaatcaaatgctgccaatgatctgataggaggctgagctcaggagtaatgctcactcatccacctctcccattctgctgtgtggcccagttcctaacaggcccggtaccagtttgtggcccaggggttgggacccctgttttacactataacatttccacacgtctctcatggcctttcagatccactgcttgtctcaactcaagtccagctacctgaaaattcgattattttttcaaagtgaatttgaatatctttatgttgaatacacagtctccacttttacgcagcccctactgtcttctatcatacctctctagccctggaagagatcaactttacattcacttttcctgttttagggctattattttatcttcaattaccaaaatctatctacatttagatactttaacttgcaaatacatagtaaacaattacagattatttaaaatagcagttttcccatgagtataaaaaaaaagaacaataaaagcaatatttgttgagtattttaaagtgccaggcactgagcagtgtgctttgcttaagtaaatgtttgacaaaataaaaggtcctttaaaagttccatgctttaacattaataaccatataaagataaggttagacttcctatcaaattagcagttttgtgaagataggccttttctgctatatagaatctcctcaaacctgagtgttcgtattatggattatctagtatactccatagctatcaagtttgtgtatgtttctttctcaagcaagttatcttatttctccttatttcttcagacttatcctttcttttcttttcttttcttttttctttttttttgagacagagttgcactcttgttgcctaggctggagtgcaatggcatgatctcggctcatcacaacctctgcctcccgggttcaagtgattctcctgcctcagcctcccgagtagctgggattacgggtatgtgccaccacgtccagctaattttgtatttttagtagagacggggtttctccatgttggtcaggctagtctcgaactccgcccgcctcagcctcccaaagtgctgggattacaggcatgagccaccgagcctggcccctaacctctcatttctaaggaaatgacaaattaagtcttttatgcaaatacagtgtagggtcatttaaaaatattttttgtaataggtgtctctgtacataaatctatttaattttttctcttttacagtaaaaaaggcaatactgtgttttagtttcaccaaaaatttcagtagaccaattgtgtaaagggatacatttatatgaatttttttgacatagtaaaaactaagaggggaagttattcaaatatttcagcataaattccctttccttgaaattgcaatcgtcatgtgtagctacaattcctcagcattcctctgtagtataagtagctacaattcctcagtataagaaacactaaggtggaaaattaattgttaagagaacaaagtcataacaaaacaacaaaacaaaaaagtaggatatagaaacattaactcaatatcactcttgaagctcacataagagaaattattgtactagacactgtggttcatcatccagaccccatcttcatgggaagacatcgatcccacactcatggggaacatcagcagctgacaattcacacctgtacctttcactaaatattgtcctaagacaaactaaaatgaactaactcgcccaaagtggtgcctcctttcagagagcagccattgacccatggctggctaatgtagttatacaaacatgcaactgctttgcatcaatttgggacaactctgaaagaggcccagtaggattggctgaagactcagttcaaagttgtcaaataaagcacaccatgcccagctgaatttacattgtttactatgagtatatcccacgaaatatttaggaattacatatactaaacattattcatgatttatatgaaatttaaattcaactgggcaacttgtacttttacttggtaaatctgggagcttttccttagttgcatctgcatggcaggtaagcatgtcggtatgcccagacctcccttctttgcttccttataagtgcgtcccagaaaacaagcaatcatctcagagccaataggcattgaggcttttgataatcaaactcccaaaggtcaaggaaaaagagagtatcccaaaagcaccaagagaacaaacaaacacataacatacaatggagcttcagtatatctggcagcagacttttcagtggaaaccttacagccaggagagggtgacatgacacatttgaagtgctgtttatgggtcccttcggattgtaacggggaaaacaagaattgtagcaggaagaattaaaagaaaagagagaagctttttttttttttaataatctgatctttttctattgagaggcaggcacccaaatgctgcttctgtcggggagtgaatctgtaaattctttgtaactctgtgctacctatttgttaacctgtgtaatttgttctcctgctgacttcttgcaaacacttgccagtgggtatctgaagcctcttacatcttctgtggcacggacttggcctatatttagcatattcactcatctaaagtgggaagaagaatctggcatcttttctctttctccatcttgccatcaaaagctgcctcaatgagcatgtagccttcagaattttgaaagcaagaagcaggcaacaactggccatgtttagcttcatcttgaaactcttgaggacacctatcaaactttcccaaaactgtctcatcatgtatggttccattgcaggatgggtgcaatgctgagtgccagaaggagagggatatcccattctttccttcttaaaaattgctcccagtctttttgagctctcttcctgtttggaaggagaactaaagcaagtttagttctccttacaaaagagaaaataattaaaagcactctcacttaggtaactaattcactttctatatgataattcttagaatgtctagtcctctctttacataagagtacaggtaattgaggtcagtgaaggttttagttacagaactggtctggctactttttattaaaacctgcaaagacttaactgttcttctataatttagggatactcatcatttaatagggaataaacaaaaatttgagacaaaaggaaattctgtatccatttcatatatatacatgtaaattacatatagaaaaaatggtttagaagaggagttaatatcaatttaaaaacgggaattttaaagctgggaataatacatagcataaatatgtataaggattcagcaaaatgttagttgaaacagggggctaaataaacttgaagtttaagaaagttaagaaatgaacccaaatatgcataaatctgaggacaaaatttgatattgctgctaataaacaagggaggggcatcatattgggaggcttcattaataaaagtaacaaattatgagaacaaatagtcttgttatagtttatctggtgaagcattttaatgaggcatagctgtctgttccattaccgaacgacttttcttatgtgtgctctggtagattttcatatggctacactgaaagatattcccaaatgtctgactaataactctatctataggcaactgttctgaaggtttaaagtaaggaggatggggttcatttagaaccagtgggaaaaaatgctaatgctgggctttgaattttatggatgctgtagctgttatttttcaattaaataaatgttttatatgccatgttttgtagctatcgcagttaaactgccctcatctttttgcccagcaaaaaacccattaagatcttcactgagattgagtctaggtttttataaaattaataactttgctactggtttctcaaaaatgagtagaaatgacttttcaatgcaaatgccagtttttgatacagtgaaattatcctgtctgcagtgactatttgaacttttatcggcaattggacactgagagacttagtatatgaacagatttatccttagattatctaatacatgctttgcaccctgcaccataaaacccgatctatttttaaagccttggttgttctgaaaaatgaaatgaaattgtattaaatggcattttgactggggagaaaaaaaaaaacttcatgtggtttaagagaatggatgccggcaattgactgtctactgtttattcaaaacttatagattagcagccagatgtggcagaaagttggctgatttttcattcacaacaaaaacgatgctgtgcttaatgaatggaggtttgttatcccagtaataagtaaaaggaacatgaaagcccttgtgtttaatgttcatgcaaataagctatttgcaggtggcttttgggcagggtcaagtattttcaaatatttttcaaaactgggtcaagttttttaattgtcaaaaattaccagctagaggaaaacctcctaaaaactttattatgctatttcccaagtaaatgaaatgacaagtcacttatcatttaaaaattacatatgaaaattcttttccttatgatttcgtcaataaataaattctagaggattctagatatatttatttggcatttttttttaatgtggtatcaaattttgtggacattctttagagaatcaaattcttaaaatggcattgaacatttaatttaaaatgtccttcttgaaccatacatgtttattaaaaaattattttatataggttatccattaaaaaacaattttctatatatgtaaacatttatgataactgctcattattttggtccatacttatttatctacctatttattaaacaatacaaatcatacgctttgtaaaaataaaggcctagtctaatattactctctgtcagaaataaaataattcagagaagtctgtattagaagacaaaataaaacaaaacagaaaatgatgagaatcacaaaaccattgccaaatttccagctatggcatttactctccatgtggccttaggtatcttactctcttattttaacctttctttgattactgtaaaaataatttgttactaagaaaccctcttgctttagtagctgtgagtataaaattaagaacataattctcaaaaagtgttttagtcttcctggaaacattttaaaatatcaattaatcattgaacaatacacaatcgcctgatcatttgctaagagagggttgcattctcatctctgttcacttctgtcctttctgagacttacacaggtatgagagctagaaaaaatattaatgtgtagtaattcaaaatttctcattcatgaatcacttcagcagtgcaaagaatactttgtaatttttaaaaggcatttttattaatatacttctactattctaccccaatcaacagcaaatttacctaaatcatgagactactggtacttctaatttttagaaaagaatgacataaactgctaataaacccaatgaatcctttacccgcaatgagaatgtccacgagtcagctcttctgaccctctggccagtgttctggagttactgatctccaactttctaattgaactctagcttggtatgtgagagcagccatgggtgaaccagtggagcaagatttaagccttgacattgccattaatgattcaccacctgttgcaagttcaataagttattcacacaccaaattgtggccgcaaaattctgggagataaactaagttagaaagattgggggtgaataaatgtttgctaaatcagaattgttaatgatagaaatctgtatcttaacaaagttgagaaatcttgtcttcttaacgtgtatttattgacttcccaggatatgtcttagtgaggaaacatagcttctggcatttattattagagtgataaggaataataaaccacagtgcttgagagacagggaaaggcagggggagccagagacacagtaacagaagcagattaattgactgatgaaataaacttgagataagagagcacagaggaggttcaagagatggaaccatatattcctctctatctgctcccaacatcaaggaaattcatagcatattttataatgaatccctgataaatattagtctataattgaaaatctattaaaatgactatttcttagggtacacaaaaatattacaacaaaacaagtaaagaaaagttgccatgggatggaatattatattttcctgcatgtctgcttcaaggcagaatcctaatggtcatgtatgtaggtaaattattctttttacagcaacttctgggaggtggtatttggtgcagtataaaaggcaaggggtgtagtgagggtaaagcgtaagtactttgatcttgagccttgactatattggacttgggatctcggaaatcttggggataagcagtggattaaatccataaattagtaaagtgttgattatacaacaggtagaactacgtgccacttttggagggacagtcttcttttttaaaaaaaacaaaaggccttaaaggctttatgtatatataaagccttttttaattataataaatacatttttttaatgaaacaatctgcacatatacaattccactctcaagaaaggcaattatttacataattatgcagaaattcctataattatgaaaataattgcctttcttcagagtggagttgtatatgtgcagattgtttcattttaagaaaagaaatatttactgatttgattaactgaagttctggatgcttaaaaaatgattaaaatacacagatctactatctgtcttcatgaactttaaatgtcttgtaagaaattcaagtaataaagactacaacatttattatttaactggaacatgtattatttattatcctaactgtggttaggaagcaccattatttattatatctatattaatcaagttgtatcctgtaacaggtttcctgttatccactcatgtcttctaacttctgaagtattgtttaaattacaagggagaaacctagacactacattttctaggatctcaggacaatagagctccaggtgaaattatgctaaataagggcatgagtgtaagatgtggatgtcacagtgaagagatttagagcatttttctggtgacctcctgtttaggtttgacaagcatctaaaatcattgttagcaactttcccataattattgcattttcagcctttatgaaaatagcagcattttttttcctttctttgcccatgcacaccatctaatcatgagataagtctccttctgagtccctaaatacatgacatacatagattgggatctttttctgacctgttcctgtctgatacattcttcaactctaagatgagttcatactcatcttctgaagcccctgggaaatggaaatattttttcatattggatgttggtagagacccatcatttaatgaacatttatgtgccaggatttgtacaagacacttagatacattattcatgtacctcacacaaatgtatcaacaacacaacaaaatgtctgtatgaaataataattattatatcccttatatggaaacagatccagagaggaagatacactagcatgtgtaaatagaggattcaagtattaaacatccatctgtccaactgactacaacctctttcataaaatgctaatttctctcctgcttctaattttcttatcaaaaattgtcatctattgttattgggtctatgggtgggtagtgactccttggtttccattttgttctagcggattactgtcttctttatttttgttctagtgtttattgagagtcctaattaattaacctggctgctctgacttccatcagctcaccattgtctcttctcccagctcataatttctgtaacagagctctaggctatgctgaagttctgctatatgttgccagtctctctagatccaagtgcctcttgtcggccaagtttacatgcacgtgtttaaaatcttcttattgactctatatacaaagtcttcacatgccttcctccttaaaataatagcattgtgagaagaaaaaaaaaatcatcattctttttaaaactaattcaggatgtctatgttatacaacaacaagacgtgggggaatatttacctggtagttctgtccctcgttatcattctcactcattataaaattggtatctgaaaaaaatcttgctgcaaaaacaaaaaaaaaatgtatagggtataaagaaaaagtttgcttcacatcataaccattacccatcccattgccaaagggaagattgtacactacatgattccggggagcagcattcacatagactatagtgtgcatggtacatgcaagagaccccatagtactacccgctttgtcctccttgtagacatgctcacagatgatccatgctccctgacctggagtagtcaaataaaagagtagcatcaatttattaagattctttccagaccattttctaggtattcccattatatattccttcaaatggaaggattttattctgtacatcacatctcactgtacacatttttttctgaaatctgaaatctgagtattttaattttatacagtttcaattgtgagaagtacctgacagactgacctgacctaacactctctaagctaaaacactcataaactagcatagaagctttacacatttatccatttctctaatttacttatctattgtttcctgaaacatctattaatcttgcagttatttgagatgactgtgagcttactatttgccagggatggcatgagcaccttggtttagtctagtgcctggcatttattttcctaaactgtggcagcaagtttagctgtaagcatattttttatcagaacaatcatccatctttaactacatgtgaggaaagtactttcttatattgcattacacatttttatatggccacagaaatccttacttagtctgacaaaattatggtagatttctttctcctaaggtcaaggaaagaatcattctgtactgtttccatggagatgtttctccttttctcaattgccaattgtctactgtgtgtcctgggttccttcttttcatatgtcatgaggattctcaccccagcattctgctcctctgagtcaaagcccttgactttcacttctcaattgttttgtttgcagtttttttgctttcctttatttttcttactctataaatgctatgaaagtgtatgtaaaaatttacccatcttttagtttatatttgttatcaccctttattcatataccaaaccatataggaaatgaatataaggagatctttcttagtaggaggtagaagtaaaattttgtttagaataaaaacagaaaaaaagagaataaaattccatatcaccagtttgcttctaaatgcccaatgtttccacttatgagcttgctactgtacacaacgcaagggcttgtaaaaaattgtctaaatgatagtggttaaggacgtattttaggctaggttactttaaaaaaatatatcatcacttctgccgtcaaaagtgaatttgatgtatcataattgttaaagttgaggagggtcaaggattcttctcattctatggtttccttataaatacactttctaataaatgcctaatttttttctgtgaaattaaaccattagatattgctgaatgtctgtatgtttcttacttttctagaatctcattcttaattatagttttatatttttccttcaacaaagtcttaaaacccatgcagctggtgtctattatttacattctgtgatgtattttatttgactttgtgtttttagtcttttcacagaaatccttttattgtgatcttcttgtccaaaagcacttatttcatatctcttttccatacctatcttcattagcaggttgcatttcagtttcttcagtccttttttagataatatattttactacatctgtcttcacaacactgtatacgctctgatgatcaggtctcccttcttttttttttttaaattctcgtcctctttgggacccgtgacaaagtaaaaggcagatttttttctcacctgacttaaaagtaaaaaggtggccgggcgcagtggctgatgcctgtgattccagcactttgggaggctgagaagggcggatcgcgaggtcaggagatcgagaccatcctggctaacatggtgaaacccgttctctactaaaaatacaaaaaaaaaaaattagccgggcatggtggcgggcgcctgtagtcccagctactcgggaggctgaggcaggagaatggcgtgaacccaggaggcagagcttgcagtgagccgagatcgcgccactgcactccagcctgggagacagagtgagactccatctcaaaaaaaaaaaaaaaaaaaaaaaaaaaaaaagaagtaaaaaggcttcatatgtttctcctctgattcttcttaggcccagcatttccaaaaacaaaatagtacacaaaacattagttgtaatgatacttcaaaaggttcaaatactagtttttggctgctttctgactatatttttcttctaaagaaattttgttatgaagtattgaactattcagtatactttaatattttccaaataaagtttccaaactgatatttaacaatattctcttatattcaaacatattctgaactattttctgctgtgtctctagatcaatatttataaatctagattgttcatgtattttttttcctttgctaactttcaagatcatatcaaaaagcaccactgttgattccattttttatgtttcattatttgaaactatattgacatttttcctcttctttatcattccctgttatctcatctttgtgagtcttccaattaatgttttttcctttgaattatttattttttaactgaaaataaattgtatatatttaaggtgtaccacatgatgtcttaaagtatacatacattgtggaatggctaaatcaagctaaacatacgcattatatgcattaccttgtaatcggaccccttgaggtgtcaatacctcagcatttttagtgattgagataacaaaaattcgaattaggcccttgcttgcttgcataaaagccaacatcccttgttctcacaatacaattgcaaactgctgatttactatttctttgtcaaccaggagaagataactttaaggtaacaaaaaacatttgcagaaggaatgaatgcctataaggatgttgcaactaactgctgaggcccagaagtctggttgctcaggatattatcagagattaaagaaacacagactttccccttggttccctaaaactccccctctcttactgtctagctgcaaaaatatcctctctgcatttttttttttttttttttttttttttgagacggagtctcgctctgtggcccaggctgcagtgcagtggcgcgatctcggctcactgcaacctccgcctcccaggttcacgccattctcctgcctcagcctccctagtagctgggactacaggcgcccgccaccatgcctggctaattttttgtatttttagtagagacggggtttcaccgtgttagccgggatggtctccatctcctgacctcgtaatccgcccgcctcggtctcccaaagtgctgggattacaggcgtgagccaccgcacccggccccctctgcttcgtcttattgttaagacatgtctgagagatcttgccccgttctcactttggccaaatggaataaacttttatctatccccaagcattggtgtgtcagtgtttggtttcaattgagcatcaggtacatgagcccgaatttgggcctctacaacatcttcacctacttactatattttgtgtgtgtggtgagaatacttaaaatctactctattggcaattttcaaatataaatgtattgttattcaccgtagccaccatgatgtgcaatcaattttttgaacttactcctcctggctaactggaattgtgtgtcttttgaccgacatctctgcaatttccccatgccctagcttctgatgactaccaattaactgtctgtttctatgagttttacttatctaaactctctatataagtgagattatgtcatagttgtttttaagtgcctggcttatttcacttgatgtaaagtctcccaggttcatccgtgttgttgcagaagatttcttccctttttaaagcccattaaccttttatagatctggtactgaggcaatgcaagcttattggacaattatatgttatttgaataaattgaaacataacagcttataaagggtcaaatggcagttaatagcctaagaaataggtttggaatattatttcttagcataaaggataatattggtcagagtcttctaggcttgaattcttggctacttagattttatcaagtaaattgtaaaaggatagtcaatcacttttttcacatgaattgctgtatgaatttcgacttgacaagaaagactgtgaaaacaaaaccactattatctgtgaactacctaatgtggaaagaaatatccttaaataaaactttgagaaagtagattactcaattttttcctacagatatcccatatattgtaactaattataatatttaattgaatacaaaatctttcttcttaaggaaagattttattcagttttagaacgttaaagtttctccactctaatatatacagaacttctttaacctttaaaaatattgcttcacttattactcatgataattgggccacatacataattaaaacacaccatttattatttccccttgtaaaagtggcatctggttccccaacttaacttcaaactgtaattttaaacaaataataaagtgttttgaaacattaatgtggttaattgtcttatctattgtctatgttcatcaggagctgtgacatgcccaaaggaaggtaatcagaggaaggaagagaagaagctaagttctagagaatccattaatcatggtttagatgactgaccattttattattttcattttccatttaaaaacgttccatttttaaattggaagggggtatgttttagaatagaataacgaaattccctccatctcctcgtagtgtacgtgattaagaagaacctaacagaaacataaggttctaaggttcttgctggaaataataatcagaactgtaagaattctcttatagaaaacatttaaaaaaggaaattctagcaatagaattcattgttaaaactgtaagtcacaacaatattgtctctgcatgctgactgtactcctctgtaatcttcaaaggcaaacaggaacagtaataatcttttcatgtactctcaacttccttctctgaaaggctagaaaatgtcttatatgtagcactcatactgtcatttaatcaaacccagtttctatttttcttcaatttctagaggaatggctacttagtctttctggcataatgtgaatttcttaagtgtctgtagactacatctcctatttttacttcttgaagtttctctcaaactgtgataaagagtgtcactctatcggtactgttaataatgtaaattttgtttctctttttgttactgccaagattccactgactgttgaaatataaaagaaaaacagcattaaatcaggtgtgataaaatcacctttttctgtttatctccaccactggcatttattggcacttggaaactatttataaactcatactcttgtaacagtcttgtagctgaaacccactggattcaaaatctattcctagtacttaactttcttctgaaaattccctcatctataaatttgaggatgatgataattgcaaagatgccagggaaatttataatcattactgaactaatccttttgaaaatataaagcagcattaaatgttacgattactaatctttttaattaaagtggcaaatgtgtccaaaaatctgtaactaagttcattactctcatttatgcagctaaacttaagttctaccaaatgtatttttaagttgattaaaaatatggttggcagcatttataaatacccattattaacatgctatactggtaaatatatttctgctcttatgactagagagtgttgtactttagtaaaaaaattatacctcaataattatctgctctcctatttttattttatttgcaatagatatgtatttattcatgcatttgtattcttattgaatgaaggatgttatgtcacttgcattgagtacataggcatccctttcgacaaataaaatcagaatctaaactacagaaccaggttcaagtggggacagaagtacaattttaataaaggtcaaagttttgctagtgtttcacttaaaatttatttttaggctttctgaatgttctcttaaagaaaaagacttaatcatatacgtacttttttgtattgttaacaaggaagaaacatactaatatgaatggtactacatacattatacatgttatacaagagaagaaaattatatattcaagataaacatttttataatcacaatacttcaacataaatgtgttcaatatagtaaagatgcaggttgtataatttgtcaagcaaattctcaattatgtttgaattctatttaaaatcaacattagtattgacaatattcatatttaaggctttttaattatttaaataggttcaagtttgctgtgttcagcattattagttgtaaaagtaggctctggtaccgaaaatatatatttttagctcccttctgtcagtctttccattaaatgctatagactcacagttttacatgcttctcagcacctcactgctcttgttgcctataatattttattagtttaatccttctgaaataatcctggtcattcaaaaccaatacatcaaaatcttctagagtgaacaaaagaaaaaacttttgtgaagattaaaagaaaaaggagacttctcagatatattaactttaaagactatatctcacaattatgtaatatatttgttgctttatctaattagatttgcatttcttatatataccatgcatataaaaatatatttgatacaaattataatacaaggcatacaaaaatagaccattataataacagaacattttctaaagggattttaaaactgtaagccaaatgccttaatctaatactacttctaaaatgtattctaaagaaataatcttgcatgtgtggttagacttaattacagaaatattcattgtaacctttctttagaagtgaatattgaaaactgaaataaatctaaatgtccaactttataattgctagttatggaatactaacaaatgaaatccatgcttttaaaatagcatttagtgaagcaaatatatgttcaaaatacatataaaggaaaaactggtatgttattaaagaagatagaataaaatttattttgagagtgtatgctaataagacagttttgatatttaggaaaattaaaatgttaggtaatattttaaataaaaaaataaattttctgtttgctgagattatacgtattttaaacaatttttaatgtacgctatagacactgaacatgtataatttatgtatcaagaaaaaaatcaataagttcaatttttaaaatcaaaattaaaagtcacataatagatcagagaagataaagatgaattacacttttttctttatctaacaaaagagagtgcatggtttatggagacagacaatttttttctctggttttaactctaagatataaaaggaatctattgtatacatctggaaataagaggtatttaatacctaatgtatattaagattactgttttagctttttttttacaatatagaagtactgtgtgatgacttaccttatcaaccattgaaagagccattttcaaagattgattaaaatcgaagagttccataagcaattttcactaaagcattgaaaactattatccaagattaagaaaatacttttctagggatccctcatatctagggatctaatgaccattagatccaccttgtataatggaattaggacaacccaaagatctggatgattgaattgtcatttggggattattaccatcatacagctcagtttatggcaatttctatacatgtgtttagtattaattgaaggaaactcataggaattagatgccagacatgaagactatatacatatcttcagagcgcttgtgtcctaaactgaaaagtgtgttttaagagtctgggatatgaaaccaccttttctctattcttgtcaaatccatgtcattctagctactgacataatttatgcaatataaatacaaataataataagcaaagttatatgaaaatatgtttccagtatataggtagttttaaccattctttttagaagaaatgtgtgtgtgtgtaaatgtcttaattgttaaaatgattaagtcattcacaggtttgttaatgtttttccatgtagctggagtgataataatttgtattacattttagagtggtttgatgcaaataaataagaaccaactcaaaatgttattgaggttaaactccaagaagacaaaaggaaaactaaaataacaaagtaaactataattaaaacatttcaactaagaaaaaagtaaaaagttaagctatctcagacaatgttcgagattgaagcttgttaattgcaatggaaaaactgctaattaccacaaatagtaatttagaggcataaatattacacaggtgtggctgcaggaagttgatattaatcaaacacatttggcattttcaatgttgcaaaaattacaattgtaaacaccttccatacaatcaaatgttatgtgaattttaaatgagtctcaataaattatactgcataaaaacaggatttttactatggatcataattgttaatgtcttccgtactcaaggttgaaatataaatcaattcactctattatttggtttggaagtttaagaggacaattcacatttcctttgatacactctaccagtgtcactggactggtgatgtgacaagaaaggtcttctgtagaactgaattgcaataatatggagattataacaaaattatatatgtacctaagaatattgactttaaaagccttcttcagattgcaacattgatttccagatctgttgggaactagctgccttacttaatgtaacagtcttggcaatggaataatcatatatatcacccatggataattaatttttaatcattgaaattcactgaaatatgttgaacatgaaaattatacaaatataattttgtatgctgtttcagattctttggaattttattctaagcatcaatcaagatggtatagtacgagaaaggtagaacatgtaattataaattcaggattcaggaagtttatttttctcttctttttaattctctcaaaatgatcttgattcctgcaaagtgttagtgtatctggtaagtaagagtctatttcttttaaacttcatctgtattaaccagctttatatgaccaaaatgtcccccaaatttaaatctttgcacagtaaggccttatatgtacacctggcctcatttcaaaagactaaagcagttgttctcaaattcagctgcacattaatataaactggaaaactgtttaagctcctgatgacaaagccacatgtgagactaatttatgctgaatcactgggccaaggacccaggtatcagcattttttaaaactatagaggaataaccagggttgagaaccactgcacaaaatggtacatgcaacttttatttaagttattttttttaaataaataatggttgaatcgatattgatcttagtaccaagtcatggcaattttttcagacttagagaattcatcctggcattgagattattaaagaacctagaaatccaagtgtttttgtttatatttttcctgtaaatattagagtatgctagtgctcatccttatttgataattttggaaaatatattaaacatttgagattgaatatcaaaaatctctaaaagaattttagaaataccattcttctatgaaataagtaagctcaatcaagatacatattatagtgcccatttaagaaagtctaataataatgcttgcactgcttaaagattaggttgataaattaattattgttaatcctacttgcataatcaacggacacctagcgatggagtcttaagtatagacacagaagttgaatacttttaagaacttttaaatttacatccgggttaagttttactttaaaattatgttgagtggttgtgattagtacatgtgtgattagaaccgtctttctcaggttattacatcatcatatagacacaggaaaaataatagaattaaaaataaagcaagaaaaataatgtaacactttattggcttcagataattattttgagattctaatcctaccaaaacattctgcttttcttaacttgatcctacttttgtttgtttgttttaataaaggatgaaccaatatcctgagaaattttcaaatagggctggttataacactaagaacctagatctcactatgttttagaaaaattgtaaagtatttcaaataatcagtaaagtttcagctctgcaccattgtgtctttgcaatatggggaaagtcacttcacttctctccctctctcgtttttggcacatgtaaggcagagaaaataatatctactccagctatcccacatgttattataaaatataataagagatagaaaatcactttataatgttcaaagtattataaaagtaagccatgattatatgtgggattaacagcagtttgttatttaccatttaatgtattcctaatgtacatttttgccatatttaaaaatgtttacatttcgatttttaagtgaaagagtaacggtatgacattatgccatgttatatctgatgccattatgtcaaacaaacaaacaaaagcattttaaactatttggaatcttaccaaaataaatcttataactatgataatacaggtttttgaggatttagtttgtacgcaaaaacagaggcaataaaggcaaaaatagataaacaggattacttagaattataaaccttgtgcagagcaaaggaaacaggagggtggagggtggagaggcaacctacaaactgggagaaaatatttgcaaaccttatatctcaatgtactagtgactatcaccctaataactagtcatgggagcactgtcatgcatttggtatgttttagttttcgggatgctgccacttaccacggcgggagcctgatccctgcggaatcgactgtagctggacttatcttgaatattctgagccaacataccaaaccataaggtgctaattcattcatgcttgaaggccataataatcaatacacattcacgcacacatgtacgttcacgcacacgtacgttctcacacacccgtacgttcacacacacacgtacgttcacgcagtatttaaaggagtgcttccgattaaatccgcagatctgccctccccccatctctgagtttattgttaaattaggtaagccagcccccaaaaacaagatacttaaattgaacctagtcagagccctaaaaatcataatttaaccatgaacactccaaccctagcccctcgattaacgtaattttctaaaaaatcctaacattctccaaccaaataaaatctcctatttcgatgctaactaaatctctgtcctaatacttatataatacttcaggtatcccgctctgaaaagcttgtatcccagatattatagtcctaaatcaaatataacttcaactacaaatggcccctcagcgaaaacctctgctagttcaacttttttaaaggccctaaacttccaggactgtaaaggaccactttagatttatacctaacaagatcctaccctgacatccccctagtatttcaaaataccactcaaatgtttttcacccagttaatgtagcttaattatttaaagcaaggcactgaaaatgcctagatgggtccgcacaacccggtaaacatagaagtttggtcctggcctgttttttgaattcttagtaaaaaattacacatgcaagcatccccgccccagtgagaatgccctccagatcacctggatcaaagggagcaggtatcaagcacgcataaacgcagctcaaaacactttgctcaaccacacccccatgggaaaaagcagtgataaattttaagtaataagtgaaagtatgactaaactatactaatatttatggttggtaaattttgtgccagccacagcggccatacgataaacccaagctaataaaactcggcataaagagtgtttaaggtctacattcagtaaagctaagctccatctaagtggtaaaaaactccagctgaaataaaacgattacgctccttgaggataagatgcatattgtaacaattttctatatcctccacaatgttttgcagattcaataactatttaatgaattgagttaaatttgcctatactcttacgctcataaataaccttctaattctcaattcctctaaaacatagaaaaaattgccaatataaaaaagcaagaaagaagatattaaccattttgtcattcaaaatatgactcattcttatacaactacctttgtcagcattcttgccattggactatctagactttgacgctggtatatcatggcttgttgttagagaaggtaaagtttggaaaacagaagcagttatgtaaagcaatcttagaaaatccttgagtttcccttagaattttgtgtcttctacatgttttctgtttcacatagattaagtttgcagagttatgtcataatttcatgagcgtatctgtcagagagccctttgaaggcctatttaatccaactaagaccattttttattgttttaataccattgaacttgttctgataattgaggaaaaagagaaagacattccatataatacaccagatgcctaagtgctttggatagtcataagccttttctcctatagcttcctatttagaaatgcctgctcttcagagttttcttaagctttccaacttgctccttccattttataagaataatagtctatttaggaagactattatcaaataaaaatcagaatgatcagtggacacctattttagccttgggatttatatcacaattccctaagactttatatttccagaaaagaaattcaaactaaaggtcacaattactattattatagtaatactgataagatgtgcattttaactaaaagaagttcccactatttttttttctttctacttttcaataatccttgggaccttagtaggagtgtgcagtagtcttgtggtgtatttttagtttaaaagtctgagcatacctaattaccacttggtagatattgttcaaactcacttttgaatccaagtgtttttaccctcatagaattttttttaaaacgagtatttgcttgtttctattatactgtaactattggagctactaggaggccttttaaatttcaccaacaagtaggcagaatggagactaactgaagggttgatgggcttaaagaaaataaataacctaacaaaaccaccaggctaatggcaaaaccaacattaggaaccaagtcactttacttgggattagtggataccaaaatgtgctttctcggaagcagcactttacaaggaaatatggaaatccacctttgttgtccttcagctaaagggaataaaatcatgtactttctataattttaaccctgttataacagatgctacatgaactcaagtggaactctgactgccttgagagctgaataaaatgcatcccaccatccgttgcagccgcatcaaggtattaaaaagagagacagaaggaagaggtgagagaggcacaagttcaacagtgtgaggcagtcagacacaatgggagggagaaagaaataaatgtctgaatgtcattgaaagaagagacaatgaaggcatatgtaagagtcctgctaaagctatggaacctcaggagcctatttgtaagaactacaatttagaatagggaacttgcaatacaatgcctgacctttatttcctttcctgcctcgaacttgtgaaaacctttgattgacttttctatgaacatgaattactgttacaatatttagttgaacaatatgaatttctcaaagcagtaatacagcgctacagcatagcttaacattgtttaagtaatatggtttgcttatatttaagtcatttctaagggacccatgcaaacacagtcaggagatctatttctgatgtatttccaaggctagaaacaaaaaaatgctgttaatgcataaacagtcaaaaaaccatgcactgtggttttacagggacctctatttctaaagatgattgttgcatgagggtctctgcctttatgaagggaaatgtgtagattttaactagctctgtttgtgttttgaaaaagaaaatcatgtttctgcactaaaaaataaattcctaatcaaacctttaaagttaacatttagaacagggacagaaacttctgttgtttcctaagtgttttgctgttgttcctgtttagttttaaatcattttttagaagttttattgaggtataaaaaaattgtacacctttcatatattcacctggatgaatttggacatgtgtgcatacaccaatatcatcatcacaaccaaggtactgaacatacttattcacctccaaaaattttcttgtgttcttttttaatggtggtagtatatttttaagaattcagcctttgagcagggtacgaaggaccttcaacaacaaatgcaaaagtaaatgagctaagttcatataaagggttagctctcagtgagttattcaagttatgatcatatcctcaagaggcttgtaaactgactgtgggtttccagtttggttattcacagataggccttcatttgctcattcacctattcattcatatagccactcattcattctcaagaagaggtatttgtccatatctcaccatgtggatgagcagatggtcagttctcacttcttttgccattaagtgtgctcaccgttgagctccaggatggtattttctctcactttgcgtcattaccaaagtggctatcaagattccctcccctaccttctttttcttttttcaatgtttaagagctggagttaatttcttgactcctttggtaacacatgccgatatataccactcaaggcctgttggattaaactgttaaatttgtcatctagctaatgttttctcagaaccagacaaattaaacagagtcaattgttgaaattatttcaaaagataaacaatcatagaatggaaataaactacagaaagtagggaacaggagtaactaagtctcctagaaaacatttgcagcagatgttaagtatccagtctcgttgttataaatgaatttcaaagaatctcatgaggagcagctttacaaaattttactgcactaacaaatggcagccaacctctgtagtaaacacaaaatactgtaccatcctttgtatctccttaaattaagccaatttctgcttacacagaaaatctgtctgtggaaaacactgcttagaatttgaaagcacattaatctggaagccacaacagaagtgtgcttcagaaaacttcttaatatttttcttgtgagttattctctttacgcttttcacattacaatattaccaagttatcataatgtattttctgcactcccagagcaagataagactctagtagttgctgggaactatgcattgtctaaatatgggttcacattctctcacagtgattctggaatcatacacacaaatgagatcactgctgtcagatcactgggattaagactcaacctctctactcactggccatgtaaatatagatacagtactcagatcctctgaggcttagctaattatcagttgatttggtctacacttaccacattaattatttgaaaggattcgttgatataacatgtgctgacaaccataatcattattaaggcaatgtttaccaatatgtgactttaaaacagatactactattagataacaattcatactatacattcaatatttaaacaacagaattataattttgtgaagcaaattttgtactcaaacagaaaatccaattctataattattttctgcaatattgggtcatagaaccaacaaagaatatatgactggcttagacgtatgtaattacttatgcaattagtaataaaattcttcactcattcctagatttgaatccctgatgctctgcgtagcagctgtatagtcttggacaagttgcttaatctgtctgtacctcgatttcctcatttgtacttcaattttcttatgtggtaaatataaaattacttaactcagagctatgaggtcagttttatttgagagaatccagaataaaatacttagcacacatttcctaccattcagcatgcataatacgtactcaaggaaattttagatctctgtacatgattaatatattaaatcctcaaaccgactataatgtctgaaaatgcatgtctttatgtcactgtacctctcactgcacttggcacagtgttgtgaatatatttgtcatttgtatgttctttctaccatacaattctgccactccaattagcatattgtgttggaaaacaattgggtgcttgccttatgttttactaaatttatacggaactacgttgacacttccttgcccttcagatgctggcactcactggttgctttctagttctcaggagtctctgtgtgactctgtcctttacacttgccctgcaacatcaccctcagccctagacaaagccaacatcatttttaaaaacctgcaaatatgtctgcaattcactgtatgaatattctcattctatcaaaaccctgacctcactaactcaatggagcaatacaggatgagaaagtagtttatatgaaagtcatagaaagcttgctttgtttattcatccaaacgtatgtttttaaaggacgaggcttttatctgaaacaaataaaattataatttgaaatttcaaataatgtgactaatagattatgaattcatttccaaatatagaaataattaaaacacttggggtatagaaaaagtgagtgctgtatctattcttttcttatattaattttaccccagctgccagaatttagttttttgtttttgttttttttctttttctttttttgagaccgagtctcgctctgtcgcccaggctggagtgcagtggcgctatctctccgctcactgcaagctccgcctcccgggttcacaccattctcctgcctcagcctcccgagcagctgggaccacaggcgcctgctaccacgcccggctaattattattattattatttttttttttttttgagacggagtctagctctttcgcccaggccggagtgcagtggcgccatctccgctcactgcaagcttcgcctcccgggttcacgccattctcctgcctcggcctccctagtagctgggactataggcgcccgccaccgcgcccggctacttttttgtgtgtgtttttagtagagacggggtttcaccgtgttcgccaggatggtctcgatctcctgacctcgtgatccgcccgcctcggcctcccaaagtgctgggattacaggcatgagccaccgcgcctagcgcaaagatgtattttactaataccacagaggtataatctgctgctacttcttgatcaggagtaaacaagtttacttcacagcagttgatctaattttcttccccattcattcaatggtattttttttattgttatagaacatactgaattggataataagtccttttctttttcttttttcagaaatggtttctactctgttgctgaggctggagtgcagtggcattatctcgactcactgcagcctctgcctcctgggctcaagaaatccttcgacctcagcctcccgagtagctgggactacaggtgagcaccaccatgtccacctatataatttttgtatttttttttttttttgtagagacagggtttcactgtgttgcctaggttggtctcaatctcctgggttcacaccatcctcctccctcatcatcccaaaattctgggattacaggtgtaagccactgcacccagctgagaaggctttttattataggttgttcttattgttttatttatttggtttacttgttggttttcaaggtaagtttgacatataaggtggtataatgtttaaaggtcaagttatagagatagctagattgaagttcaaatccagagccaagttacttagactctctaaggacttgttttttcccttataaaattaaaataaagtggatagccacttcataggtttgtaataagaattaatatgatcatgatgtcacagagttgcaaagagatactgaaacttggctctgccaaaaaatattagctattgccattatgattgttctccttaatacctaaggcatttgctgacagtcaggttactcatcatgtccttccaggaaaaaaactttaagaatgttgaaaacttaggaactacttttaaaatttaattttcagacctgacataacacagctgaggaagagaggtggtagctgattggggatagatgtagagatcattaatggtataagagtgtgagaatgtgaagcaggataggatatgatattactcatacagatcacaaatacatgtcaaaattatatttatcattcatttaagtaaaattcaacattgttttcttcaaagaagaaattgcgcatttcactctacctatttaactctggaaaattttacaaattgagcatgccattttttagtatgaattcctttatttcagctgccctgctaactttggcatgatgagcagaaaaaaaataaacagaatgattagttctgaaatatgaaaaagtgtccaagaaaaggagtagtcttgagaagtagggaacaggatgaagtcactaggggacagaagggtaggagggagtgggaccagacaaacactgagctctgcatgcacacgtaacagtctaaaatagtcatccagcacgcagactctaagtcaagataaccaagatgaattgccaacttctccacaagcaatatgactttgggtaaggtatttgagttttctgtgtcttagtttcttcaactgataaataaaaatgatggtcatatctacttcataaaattgtgataattgattaatacatgtaatgaataacgtttggcatttagcttaataataagacttttcattaaaatattagctacttttgttagctagcaactctcagttttgcctaaagctgaccccatatctagggtgaggttttgaaagaaattcaacaccatcagaagtaggtctggaagttataaaggaaagcttaaagaaacagaaatatgtgcaacacctatttacaaagaatccattgggaaaaccccattgagcccagggagatggcacatgtcccctttggttatggaattcagttccctgacggtcagtatactgtctttgttcccaaggcaaactttttaataattgtgatcccactcaatagtcatgttcacttactttatgggtacatttgtggcatattttaaaatgtgaagttgagtgcatttcacctgaaaaccaaaggcatgtaatgacaacatgctatagaggaaaaattattgatttgtgtaaataggcagatcttgtttgtattctagctccatcacttactaattttgtgatatgggcaatttatatcctatctgagcctgtgtttcctctacaatatgaggtaatttctactttgaagtattgttatgagggttaaatataaattactttctggtttatgatgttggtatatactacttctatgcacaaccgttatttttatgaataagattttaacagtaagccacagaaaatataatgtaagactgattcttagaatctatcaaaacaggttgtaaaaatgacttaaacatctagcatggcagtgactaacattttgaaaagcttaatttttccattaagaactatagcccaacacagtgtctgtgcttcagtgttcctcttatcaggaaggataatatgtgtgatgcatggactaactctaatgaaaatttttattcttaagacacaaaatatttcccagcacagtacataaggtctttgtgcttatgtcagcattggagataaatttctgggaaagaagtagagaaactgctcatttctatagacatcaaaacaccaaagtagccgggcgcggtcactcatgcctgtaatcccagcactttgggaggccgaggcgggcagatcacctgaggtcaggagttcaagaccagcctcaacatggagaaaccccgtctctactaaaagcacaaaaaattagccgggcatggtggtgcatgcctgtaatcccagctactcgggaggctgaggcagaagaattgcttgaacctgggaggtggaggttgcagtgagccgagatcgtgccattgcactccagcctgggcaacaagagcaaaactctgtctcaaaaaacaaaacaaaaaaaacaaccaaagtaaaagtgaaaataaaggtacacagcagactttttctttttaaatacctaaactgaaaagtatacctgtcaagaaacatccaactcatgaattactttaaatatgtttttaaaacagcgtgcttgttttataacaatagattcatgctagttatctgatattccccagtggttgctttgtggagctcagtgtcatccttggagaacatgggcaataaaaagcatttcttctgcaccagtaagacaaaaacaaactgactacttctcacataaaccttggagggcttccctcagtggggttagtgatcagcaaatcatgtcaaataaccccttttgttatttttgacataatagtgttcctagcagacagtactcaagaattcccagattcttagctgtaacataaatttaatatactctcttttattaaaagtcaagctgtttattcacagtagctcttaggtctacgtttcattttacacatatatgtggatgtaatagctttttccttagaacttttaaaaaatagaattcagtaaaagtcctatatttgtattttctatgtgtcaagaacagataagcatcattaatgtgaaccaaatttcaattgaggagctgaaattaggaagaattgaaaaacacctgaaataaatcttcaagtaataaaggggaaagtttactttagaattagtgtatcaaaaatgagaaaattggctgggcgcagtggctcacgcctgtaatcccagcactttgggaggctgaggcatgcagatcacctgaggtcaggagttcaagacctgcctggccaacatggtgaaaccctgtctccactaaaaatacaaaaattagccgggcatggttgtacatgcctgtggtcccagctactcgggaggctgaggcaggagaaccgcttgaaccccggaggcagaggttgcagtgagccgagatcacaccactgcactcgaaactcggtgacagagcgagactccataaaaatcaatcaataaatcaatcaatcaatcaataaaactttttaaaaagtcattgcattatttttaaaaaattaatagtttcaaaatgtatacatgtaaaatctaactgggaatactttgtatctacttgtagcacaagattaaatttattttcaattactaggagatttgcacaatagagtatatatttactttaatctgtatgactaaaagcctcattgtcaatgtgactatgtcatcattatcacattcatgaatctcctgattataacctgcacagatggtctacctacagggctctgggataagaaacttgctgtctgtctacagaggaagccgttttcacttccagatagttctgaatatttgcaagtacttgctgatttagagtcaaattatgtcttgctgtaacatccatgttactgaacttacatttgagataaaccaagattagactaaaccatgccttcaaatgacactctcaaaaatgtgatgcaatttatgtgccaaaactatcctatcttgccattttcctccattttttaggaaaagcatggtcctagttttgttagccacagttgacactactattttaaatcactatgtcatttgtatatcctacatttgaacactctttagtgtcttcaagttaaaatatgcataaaaactgcacgtccaggatactctacctggagaaaaacatagctctcattaaccttgtccagacattaaacttataagagaaaaatcattattttcctgtaaccaaattactctgctaaattgtttttaggcaggattaataaatctttactgtaaagggaaagaggctaagattttaggttttgtgggccatataatctctatacaactgttcaactctgctgttgcagtgagaaagcatttatagacaatatgcaaatgaatgagtgtgtccatgctgcaataaaatttaatttattgcagtctattggctggatatggcctgcaggccataatttgccaacccttggttgacagtatagctagctaaacactgcttgttgtagtaaaatcttgctttttaaaacatatgtctctcatcctagtattgtcattacgtgtgtgtggtttattgttaaatatgtaatatttaagggtctttcctatttagttttattaactaaaagctgtttcataattgtaatgcacagacatctatataggtttttattttatcattcaacctattagctaatccttagagttgtttcatttttcatgtgtttgacagatgaacatgtctaaaacactgatgataatgttaccagaatataaacaaaaatgaaattttcaggttaaaaccattttgttagtaatatgtaagtatatcaattaaccattaaataatttaccaaattattccattacctaatccatattgctccttcttgtccacaagaatatagtaaggtacattgtcaaatacatacctctgactttagtgggcatttaatgtattattagaggatcctgatatctgtctttcttaaagaaattaaactcatccctagtgattatactttcttcatctaacactataatattaataacatttgaaaaaataatgtctaataattaacactagatttacagagtatttttagacaattttctaaaattatctgaaaaatttgaccagaatcattgtaaaattcacatctgagcttatgaaagcccactttattccactctaaaagaacaaaattttgtacttttaattttatcttttaaaatgttttaacataaaggtagtgggagacgttactaaaggaagcttagatagtaacgtatttgttgtctcagttaacacaaagaccatagatggggcagatctgcaggatgcaaaaactttcctttttctcacctcatagtagtcatatggctactgcaattctctggtttcatgtgcttacaaaatgtcctttagttaaaaataaaaagaaagagaaagagaaagagaaagaaagaaaaagaaagagaaagaagaagaaaagagaaaaaataatttcttcatgtgtctatttaaattaacaaagacgtgaattgtcccagacctccctgtgatgagtaacttcatgtgtcagttttactgggctaagggttacccacatggctgataaaacattatttctgagtatgtctgtgtttccagagaaattagcatttgaataggtaggctgagtgaagaggatcatcctcaccaatatctatgggcatccttcaatctcttcagagcccaaataaaacaaaaaggcagaggaagggtgaatttaatctgtcttcttgagctgggacatccatcttctcttatcctctgatattggaacacctggttctcagacttttgggcttaggttgaactatatcactaactttcctgggcctccatcatgcaggcaggagattgtggaatttctcagtctcgacatccttgtgagccaattcctcccaagaattatcttcttctagctatctctgtctctttctctatctatttcatctgtatcagtatctgtatctctgtgtcgtctatatctgtatcatctgtatctttatctcatctgtctctatctctatctctacctctatgtctacatctgtcttagttatctatctcatttatggttctgtttctctggagaaccttaactaatatagtccttatcttacaactcacttgccagcttaccatgattataaccaagttgatcacttcaaaagaatactaaataatatatattgtttacactaagagatagctagctactctcctcaagctgaatctggcccccacctcacttagtagagcaagcaaactaaatgtagattatacattttttactcattgaaaaaacccaaataataacttatgacatgctaaaatttaaattttgatatacaaataaaattttattagaacacaattatatttattcatttacatttacattatttgtctatggctacttttacactaatgcagcagagtttgttagttgagacagaaacaggccaataaagaccaacatttttacaatataaccctttaaaaaaaaaatggacccttggtttagactgatcaataatcctatgggaggattttaatgattttcatctgtagccaaccaagcacattttttttcttggctaggataaatttagaacatctatgtccttccttaaaatagccccacatacttgaaagtctgattctctcataactatatttttttctctgctgttaaaatttgaactcattctcttcagaaataaagaaagtaacaaaatagaaactaagcagtcccatttttattttgccatttatgagggcctatgccatctagcggtgatttagtatgtatttaacaaccagttcactgagaaaaactgctgtatttttagtttgcttaatttagtggtgttgaatatttcctctatgaccaattttggcttacgaatatgatttctttgaatgcaaagttgggaggagatgagcactgtgtgctcctatgaggagttccatctggctcaaacataaacactattaacatcactttgctcaagacatgtgattctctttcataatgcttcttgcattaactgcaatataaaagttacaatccttattatttttgaaaaactcaatttgtataggactcttgataatattttaatatgtatacattttataattttattgatattttttcttcttttatacttttttttgtttatttatatagtttgttttcacattaaatgggagaaatactgacattgttcaattcacacccagggaaattctgtgtgaatgatatcatattatatttcttttaatgctctaaacaatgttgtgaggtaagtgttatctctgatttgcatatgaagaaacatattccgagattaaaaaattgcccagtttcacacaaggaataaattggagcacaggagttctatatagatagacctgtatgacttcacagagtgaaatggacagataaacaattcactttccaggagaaatcacaggacaatggatatcagaagaaatgatgggaccagggtaatattggatgttttgtatataaaaaactaatgtgggcaacaaaaaagcatataaagtcactgaagcaaaatatatattgtgaaatctaaaagaaaatatgctattggtaggccatggctacattataaaaaacatttcatttcacataaagtatgaatactacactatgactatgagttaatattaaaaaattgaccacataggaaataggagaaaaaagtaacaacactgtggaaagcaaagaaaatgactgcaagatgaagctatcaccaccatctcgtggccacatacggacctcctcagaagcttagatgaataaagggaagagactggagttattaaaatttgtaaactcagagtaaaagccttcctgagctgaggctagacctctgagggagagaaatgttccaactgctgctgttacctctgaagaggcactttctggggctctgaaaaaattggtaaactgaaacaattactgctcctagggcaaggggatgttcttgggagaatatcagcaaggacagcaaacaaacaggaaaaggagatctattcttccattctcttgcctatgtttctctagtacctcccaatagcagtacgtagcaggatcccacttgaaggaacttggaaaacgtagcttgctgatccccatcacggcatcatagcaaatttatttcagagaaatgtggctaaagatcaagattattagtaaatcaatttttttacctaatttttaatctgtattgatttcttataacataaatatctgtggttacagagacctcagtattttctttttcttctgtagcagcatttcaatcttttttgaagttctacctctctttcactgctagttcacaccatgtgagagcaatggacctaatcatcatgggcagtggtcataatatgtctcaacctgcccaaaataaagatgctaccccattaaccatatgttttattttgtaatacgatcatgatccaacctagtctaatgagaaacttaactagaaattttgttggaattattgaggaaaacagtgttcattttctgaaaaagtagcttagctagtaagatataagctcagtgctactagtggccatcttgatgtggaacaatactgagaatatttcttcaggtaatcctacaagaaatgtgtgcaaaacagaaaagaggaagttacaatgagaaatttcttacgtactatattcagtagagcctcagggtagctctaaatctagatacttaataagaatactactgataataaataatactcatatagcaaatactatgtgctaagcattctttcatgtactttataagattaatatatctaatacaaggactgtatgagatagatattattgtccagttttattatgtcctgcaaataaaatgccctgacaaattatattctctcaatcatctttcctttgtttgcaatcaacattttatatgtattcacttattatgtatcactcctttgattcctcaaaatttatttagggctatataaatattttgctactactggaattagcaaaactttaaggttaaattttcaaacatgttattgccctcatcatactgtagcaagaattagtaatcaatgatacataaaccctatttatttatccaaattattccatttcacatcctcacaaaggacactattctgtcaccatttaaccctgttccccaaaatctcctcataaatgcagtttcaaaaacagcaaatagataaattggactttattaaaattaaatttttttttttggtgaaatggagtcttgctctgttgcccaggctggagtcagtggtgccatcttggttcactgcaacctctgcctcctgggttcaagcaattctcctgtctcagtctcccaagtagctgggactacaggcacgcaccaccacgcccggctaatttttgtattattagaagagatggggtttcaccatattggccaggctggtctcgaactcctgaccttgtgatctgcccaccgtggcctcccaacgtgctgggattacaggcatcagccactgcgcctggcccttaaaattaaaaaattttttttaaagtttttatttttttgagacagggtctcatcatgttgcccaggctggagtacagtggcgccatcatggctcactgcagtttcaacctctctagactcaagcggtcctcccacctcagccttctgagtagctgggactgtaggcatgtgccaccacatcccagtaagttttgtattttttgtattatagaaatgggggccaggcacagtgctcactcctgtaataccaacactttgggaggccaaagtagatggatcacttgaggtcaggagttcgagaccagtctggccaacatggtgaaatcccctctctactacaaatacaaaaattagctgggcatggtggcacgcgcctgtaatcccaactacttgagaggctgaggcacgagaatctcttgagtctgggaggtggaggttgtagtgagctgagaccatgccactgcaccccagcctggttgacagggcaagtctgtctcaaaaaaaaaaaaaagaaagaagtggggtttcaccatgttgcctagactggtcttgaattcctgggctcaagcaacctgcctgccttggcctcccaaagtgctgggattacaggtgtgagccactgcacctggccaaaattaaaaacttctatgtttcaaaggacatcattaagaaagtgaaaagacaacctacagaatgggattaaatatttgcaaattgtgtatctgttaagggtctagtatttagaatatgtgaagaactatcacagctccataagaaaaaaacaaataatccaattgaaacaatgggcaggccaggtgtggtggctcacgcctgtaatcccagcactttgggaggccaaggtgggcggatcacgaggtcaggagatcgagaccatcctggctaacatggtgaaaccccgtctctactaaaaatagaaaaaaattagctgggtgtagtggcgggtgcctgtagtcccagctactcgggaggctgaggcaggagaatggtttaaacccaggaggctgcagttgcagtgagtggagatcgcaccactgcactccagcctgggcgacagagcgagactccgtctcaaaaaaaaaaaaaagggcaaagaatttgaagagatatttctccaaagaaaatgtgcaaatggccaaataaacacatgaaatacacacatgaaaaggtgttgaaatcattattcattagggaaatgcaaataaaaatcacagtgaggccaggtgtggtggctcattgcctataatcccagcactttgagagactgagtcaggaagatcacttgagcccagaagttagagaccagcctgggcaacatagggagataggcgtggtttgagcctgtagttccagctagtcgagaagctgaggtgggaggatctgcttgagcctgtgccgtcgaggctgcagtgagcagtgatggcgccactgcactccagcctgggcggcagagcaagaccctgtctctaaaataataatgataataataataataatagagataccaattcacacccactagaatgactataataacttaaaaaaaatctcaaaaaaaaaaaacccaaaaaacaaaaccccaacaactgttggtgaggatgtggagaaatgggaacccttatagggttccttacttatagggatgtaaaatgatacagatgctatgggaaacagtctggcagttcctcaaaaagttaaacatacagttgccatatgacacagcagttccattcctaggtcatcccaagagaaatgacaacatatgtccatacaaatacttgtacatgagtgttaatagcaacaatattcataattgtaaaagagtgggaacaacctaaatgtagatcagctgatgaatggataaacaatacgtggtccagctgggtgtggtggcacacacctgaaatcccagcgctttggaaggccgaggcaggtggatcacctgaggttggaagtttaagaccagcctgaccaacatggagaaaccccatctctactaaaaatacaaaattagccgaacatggtggctcatgcctgtaattccagctacttgggaggctgaggcaagagaatcgcttgaacctgggaggtagaggttgcagtgagccgagatcatgccattgcactccagcctggtcaataagagcgaaactttgtctcaaaaaacaaaacaaaacaaaaacaaaaaccagtatgtggtccatccatacaatggagtattattcagccacaagaaggagtgaagtacagattcatgctgcaacatggataaaccttaaaaacattatgctgagtgaaagaagccacgaaagatcacatatggtatgatcccacttatatgaaatgtttagaacaggaaatccatagagatagaaaagagatcaatggtttctaggagatggggagggaggcaattgggaatgactgttaataggtatgggattctttttaggtgatagaaatgttctggaattagtgtagatggttgcaaaatgtgaatacgctaaaactactgaattgtatactttgaaatggtaaattgtatgctatgtgaattttatctcaattaaaaaaaagtataggccgagtgcagtggctgaagcctgtaatcccaggctttgggaggccgaggcgagtggatcacttgaggccaggagttcgtgaacagcctggccaacatggtgaaaacccatctctattaaaaaaacaaaaattggctgggcgtgttggtacatgcctgtcatcccagctactggggaggctgaggcacgagaattatttgaatccaggaggtagaggttgcagtgagccaagatcacaccactgccctctagcctggtcaacagaacgagactgtcttgaaaaaaaaaagataaattatggtatttgctttggaattaaataattagtaacctttagtaaggtttggtaaaggtttagtaacctttagttaacccagttaacttctgtgtcttatgtttgtctttgtactgaagtagttgaatgccactgacccacagaatgagttgccagagaattggagcaacattctgttgtgggaaagagaatactctgttctaccttaaaattagattcccagcatatcaattgaagggttttaaatagtgagtgatgtgtttcaatttatatttatattatatttacacttgatcttagccaaaagtctgagaagtgattttatattatatttataaagatcactttagctttctcctggagactggattggtagggacaaggtgacattggtgaacttggttagaaagtcagtcaagcccatgtgcagtggctcacgcctataatcccagcactttgggaggccaaggcaggtagatcatctgaggttaggagttcgagaccagcctggccgacatggtgaaaccccttatctactaaaaatacaaagattaggcaggcatggtggtgggtgcctgtaatcccagctactcaggagattgaggcaggagaatcacttgaactcgggaggtagaggttgcagtgagccgagattgcgccactgcactccagcctgggcgacagagcaagactcagtctcaaaaaaacaaaaacaaacaaacaaaaaaccagtcagtactctagggaagaaataacaatagctatattatgacatagtagtgagttgaagataactgaatagccaaaatatattttggagatagtttgatgtgagaggcgaggaaaagtaagtagtcatgtgtggctctttgtttctggctttaataactccagtagttctggaagagacttagtgggaaaattaaggacattttggataaattgagtttgtccaaatggggttgccaagtggagagttgagtaaatgaagctagagctcaggaaagatgtggaccagagttataagtcatatttatttatttatttattttgagacagagtctcgctctgtcgcccaggctggagtgcagtggtgcgatcttggctcactgcaacctccgcctccggggtcaagtgattctcctacctcagcctccagagtagctggtattacaggcgtgggccaccatgcccagctaatttttgtatttttagtagagacgggggtttcaccatgctggccaggctggtctcgaactcccgactttaggtgatcctcctgcctcggcctcccaaagtgtttggattacaggtgtgagctactgcgcccagcataagtcatatttaaaacaatgggaatgggtaggaacacctagggatagagtgtgggaaatagagtagggtccagtatacagctgtgccaaatttcacatgtacaggttagatagtggagtgggtcagttctattgagaatgccctgaaagtttgaataatgataagcacgtccattttaacatcatgaggtagtggtgacgttgtaagaggagtttcagtgtagtgggttgtcatgggttaaaacgttcagattgtcatgggttaaaacgtgaattggatatgaggaagtggagtgtgcaaagatagttttctgaaagttttacttggaagaggacaaaaaattgagactagacagtttgaggaggatgaaaggtcaagaattctaagctagtgataaaaatttcgtcaacatcaatgaataggtaatgtaaacacattaatcctgggatggatgtgagaagagcaaagaaaggagtcatgggggaatatcagctctaaaggttgagtagagaaggaaggagtgatctgagaggtggaaggaggagtaggaattatcatagaaactttaagcttcttgagggcttgtgactgtgtcatgttcatcattttatctgaagttcttatcaacaaagtagctttcagtaaatatttattaaatgaagacaaaaattttaagagccatctgcaatgtcaaatgtagcccacagttgaatgaatatgaggaccgggaagtgtcccttgattttggagttaagcagctgattgccaccttctgtagaacagcttcagtggagtctccatgatagaaataaatgccaggttgctgaggactaagcgtggatatttgttgagagtggagacagtaagtgcaaacattcttttcagaaagctttgctctttttgaagctttgctcatagggagatacaagatagtaggtagaggggcaggctgtgtttagatgagagagacttcagcatgtttatatgctaaatggaaaaaggaaaaaggaagggagaagttgaagatgtagaataaaggaggtgtgtgtgaatgattgtacattgtctttgaggttagtgggaatggagtgaagatactgggttgcagtacagatgagaatacagtttccactgaagtaggaataaaggaacaatagatggtgcagatggggaagtgtttgggtggcaagtgagaattctggatatcaacactttatttttttcagtgaaggggggataaggtcatccactgagattatagtggggatgaaatgatgattgtaggggactgaggagaaaaggagaatttcaagaaagcctctgagggaagtgagagggcaagctgagtgggaatacttagaaaaaatggaatcatggatttttcacggctgtggtatatatatttgtatgaatgatttcctccttctctcagggctcagcagcctgggtgagcacacaattgaacagttggattggtcttggcctgggttttatgcgtcagtgtgacagagagggtaaggaggcaagatatttcagtagcgagagtgtttgaagtggtgggccattgagtctaggctgaatagggaacaaatgacaccagaaggtggctgctgggacatgaagtggttggtgttcaagactggatagtggaattgaagattgaatgggaggagcagttgctgggtatgacagaatacaggatccagctatggagtgggtttatgaagtagagacaacgttcccaagtctttagtgaacatcagagagtgtcatctgttagaactttagctgtggccaggcaaggtggctcatgcctgtaatcccagcactttgggaggccaaggtgggcagatcacctgaggtcgggagtttgagaccagcttgaccaacattgagaaactccatccctattaaaaatacaaaattagctgggcatggtggtgcatgcctgtaatcccagctactcgggaggctgaggcaggataatcgcttgaacctgggaggtggaagtttcggtgagccgagattgcaccattgcactccagcctgggcaacaagagtgaaactcagtctcaaacaaaaaagaacttttgctcaaaggcaggtggtagcagataagaggtaaggaaaatttagtgaagaaaaattcagtttttaaaaacgttttaggctgggtgtggtggctcacgcctataatcccagcactttgggaggccgaggtgggcagctggcttgagcccaggagtttgaaaccagcctgggcaacatggcaaaacctcgtttctacaaaaaatacaaaaaattagtcaggtatggtggcatgcacctgtagtcccagctacttgagaagctgaggtgggaggatctcttgagcccaggaagttgaggctgcagtgagctgtgattgtgccactgcgctccaacctgggcaacagagggaaaccctgtctcaaaaaacccaaaaaaacaaaaaacaacattttattttggtgatggaattctctattgtttcgaagagttttgtttgttttaaagacattaaccagttttctcgagggatattctatgaaaaagtgggttccatcatccaataagtttgagaaactgcaaactctatcccgttggtaattcacaatgaacctcaacttagattaataaaggctctgggaaatgatgttactattaatgatttaacatttattgagcactgtctaaggctctgttctaaggctcccacatgcattattgtttccagtctttacagcaactatctcaatttaagtcacacggctaagctggaatggaagagctgggattcaaatccagaaagacttgctccataggattctcaagcctataaccagtatggaaacaggcttgacattaaatccagcatttccccatcttgtttggttatggaaccttattatcttttagtatttatagagagattagtcagttgtccacggcatggaccctgggaagtgtcgcctgagtcagtttacactggtgactacagtcttttaaacagcattgtttcagactataactagttttttctaacttggttctctgttgataatacttaaatgttatatttatttttctatttgagagccttatattttgacttcaaggcattttctattccctttcacaatgaccttcccaggaatcaaagatattgtcaccaccacacattacatttgagttactaaaacagtttataatccaaatagctatttcactttcctttctctggtctaagattatcttattgtaatttgttttttaaatttagagacagggtcttgctatgttgtccaggccagtctcaaactcctgagtagctgaaaatataggcatgtgtcacctcaaccagtttattgtaaaattttaatgtttagagatcttggagatcatcttttatttttaacagtatttatttagttttgcaggtagagaaaatgacagctgtgtagtgctgtggaaattataataattcatatccaagcttgaatgtcagctctacctctttactatagctgtggccttacaaaacctacttcgtttcttgaaacttgtttcttcctctaaaaagatgaggataatatcttgcagggtggctatgaaaattaagacagttcacacagtatctggcacatggaaagttctcaatgttaattacccatttttttctgtttaaggaaatagtctcaatcctataccatgaatgaattatgaaaatagttggaaaggaaacaacagttttaaatgtaaactgtctcagtcttatgctgacatcagctacatttctggtaaagtgatggtgtcatgatacaggttatattaagagttaaaaccagtttccttctggctttccaactgacataataagcaaaacctgcctgggcaaacatagacctatttattggctcacttattattaatgttaaagtagctttggtgctgacttctcctgttcttgttttaaaatttcactgttgtcatttgaaatctgacagaccttcagaagcttcatagaatgcttaatggtttaaatcgtctctagaacatgtgaagtatcttttccaaagtggttttctccatctgtcagtatgttcaaaatcatgtgtatagggccgggcgccggtggctcacgcctgtaatcccagcactttggaggctgaggcgggtggatcacgagatcaagagatcaagagatcaagaccatcctggctaacatggagaaaccccgtctctactaaaaatataaaaatcagctagccatggtggcacgcacctgtagtcccaactactcgggtagtcccaactacttgggaggctgaggcaggagaatcacttgaaccagggagacggaggttgcagtgagccaagatcgcaccactgcactccagcctgggcaacagtgcaagactctgtctcaaaaaaaaaaaaaaaaaatcatgtatataggacagaattgcttatattttcacatttactactggatgcctgtttggttttcatagcaatcaacttttggagtttatgggcagtacttaacatatataacctaagtgtggataattatttaaaataaggctattggaagaaaaatctatagggatttctcagttttcacaacaactccctgagcaaagaaaaaataggttggtttgagttgtatgtgatgagatttctaatattctatttgaaatgccccctagtaagcactagtgataggtattaatgagctgaatttgatttccagttccaactctgtcccttgcaacttctgtaaccttgaaggtttctctacgtttcagtttcttcatatgtaaaagagattaccaatatttccctcccaaggctgctgtaacagtgaagtgttgaggtttttatttatttattatttatttatttatttatttatttatttatttatttttttgagacagagtcttgctctgtcgcccaggctggagtgcagtggcatgatctcggctcactgcaagctccgcctcccaggttcatgccattctcctgcctcagcctcccgagtagctgggaatacaggcgcccgccaccacgcccggctgattttttctatttttagtagagatggggtttcaccgtgtcagctaggatggtctcgatctcctgacctcgtgatctgcctgcctaggcctcccaaagtgctgggattacaggtgtgaaccactgcacccggctgtgttgaagtttttaatatagccagcacagcatgtggcacatagtaggcacacagccattgcatgtttcttccagacatctcactgcatttttcagtaatattcttttcaagtacgttcttctttctcattccttaacatttaaaagctatattcaagagagaatattaatgtttgccaagtaaactgaaaatatttcctttgcagcccacacttaagagtgttttaggccgggcgcggtggctcatgtctgtaatcccagcgctttgggaggccgaggtgggcggatcacctgaggtcaggagttcgagaccagcctcaatatggagaaaccctgtctctactaaaaatacaaaattagccgggtgtggtggtgcatacctgtaatcccagctacttgggaggctgaggcaggagaattgcttgaacccgggaggcagaggttgcagtgagctgagatcacgccattgcactccagcctgggcaacaagagcgaaactctgtctcaaaaaaaaaaaagagtgttttagcaaaaaatgattttatgtatgacataccttggtttaaatcctggctttttaattgtaatttttttattttttgagacagggtcttactctgtggccaaggctggggtgcagtgatgtgatctctgctcactgcaacctccgcctcccaggctcaggtgattctcccacctgagccacctgagtagctgggagtaaaggtgtgctccactatgcctagctaatttttctatttttagtagagacagagtttcaccatgttgcccaggctggtctcaaactcctgggcttaagctatccaccagcctcggcctcacagtgttgggattacagttgagagccaccaagcccggcctgaatcctggcttttgaatgtaatagtgttgtgaccttaggcaagctacttaacctatccctaaagtattatgaggctaaagtgagtaatagtatgtataaaacatctagttcattgtctggtttgtatattcccaaaataaatgttattattttaagtggaaactgttgtttaatttgataattcatataattcatggcttttgagagcctgctctactcaaagcccgttaagagcaggcaggaacattgtgaacgaatgttgggcatattattatgcaagtgactgaatttggccttgcctgtaatcaggttcagcaaaagtggtattttctttctttctttctttttttttttttttaaattgagacagtctcgtcctgatggccagactggagtgcagtggtgtgatcttggctcactgcatcctccgcctcctaggttcaagcgattcttccacctcagcctcccaaggagctgggatcacaggtatatgtcaccatgcctggctaatttttgtattttttgtagagatgggggttttgccatgttggccaggctggtcttgaactcctgacctccagtgatccacctgcctcggtctcccaaagttctgggattacaggcgtgagccactgaacctggccaaaagtggtattttctattgcatttgaggtaacagaaattgatgggcttgttattgcatttggcatggctttttttttttccatgttgtctttctccactgactgtcaaaaaaaaaaaaaaaaaaaaaggctacattcatgagtgccacaagagagatccatgattcccaagtgctacagcagaccaaggtatattttggtatctaaaatgtttttcatcttttgctgatcttgtttattagaaataaatatgttactctcctgtattaaaatttaacacaatattggcaagctaaatttaatcaaatattctgcccattttaaaattcacttcctagcctgtccatccttccttttattttgttgtttgattttgttttattgtatgcttttagcagcctgaagccatggtttttagtttctgtctgtagtgataagtggaaaggagggatgaggaaggggctttactggcccaaccagaaatagaaactaagaacccaggactgtattatctcccttggacacccaacactatataaaattgattcctgccctggcagactaagcattggaaagctggtgctaagagtgttatgagaattcctaacaaatagaaaagctcaaggattgacactatagtaaaagatttcattttgacatgtttataatttacttatcaagttaacaataaggtgtttttatttatttatttttgtttatttttattttatgttttgagacggagtctcgctctgttgcccaggctggagtgcagtggcttgatcttggctcactgcaagctctgcctcccgggttcacgccattctcctgcctcagcctcccgagtagctgggactacaggcacctgccaccacgcttggctaattttttgtatttttagtaaagacggggtttcaccatgttagccaggatggtctcaaactcctgaacttgtgatccacccgccttggcctcccaaagtgctgggattacaggcgtgagccactgcacctggcctttttttggtatttttagtagagacggagtttcaccatgttggctaggctggtctcgaattcctgacctcaaggcctgccttggcctcccaaaatgctgagattacaggcatgagtcccagtaagatttttaaagggataccaaaataatcaacatttattttagaaggtgactttcttcaatgagatgtcaatgtctactttctgttatatagtgctattgtttcttttttcttttttttctaagtgagggtctcactctatcacccaggctggagtacagtggcatgatctcgggtcactgcaaccttcacctcccaggttcaagcaattctttcacctcagcctccagggtagctggaactacaggtgtgcatgcctcgctaagttttgcatttttagcagttgttggccaggctggtgtactgtttcttttattgactgagatctatatttacacagcatgaaagtctcagttgcattaagtacattcgcattgttatgcaaccatcaccattatctagttccagaattttgccgtcaccctaatagagcttgtatatatgtccccaccaaatcttatgttgaattgtaattcccagtgtttgaggtggggtctggtgagaggtgtttgcgtcatggggcagatccctcatggcatagtgttgtcctcgcagtagtgagttagttctcacgatctccttactccatccacctgcttctcctaaaactttgaaatacgcttggaattgaaagtgtttagtttagattgaggatagttatctaaaagtgacatacagggctcctgctttgctcttccttagtaaatttcctattttattacacagtttactaatacagaggacttgagttttgttatttccatggaaaacattattgaatctaaatttaactagagatgtgtagttcagggagggagagtggttttataatatgaatcttggatttgaaatgaacttaaagcaaatgaataaaaattgtttcattaattataatgtctgaaataatgcatgtttttgtgaataaaaattgatataataaagtttaaagtgacaggagtagatataactaattgtatttataatttcttggaagtaaaataacatttttgaaaaatattatacaatgacctcacatacagtgacctcacttaatctatgtgaggctatacacagtggctcatgcctgtaatcccagcactttgggaggctgaggcaggtgattgcttgagcccaggggcttaagaccagcctgggaaacatggtgagaccctgtctctacaaaaaatacaaaaatcagctgggcatggtgaggcgcacctttggtcccaactacttgggatgctgaggcaggaggatcacttgagcccaggaggttgaggcagcagtgagctgtgatcgcaccactgcactccagcctgggtaacagaatgagaccctatctcaaaaaaaagaaaaaagtctatgtggaagacaccacgttaattgtgttgggtggtttagagatgtttctgtctccttcactgatgaccgtgtgtctctgctgctgtcgctcactggtgattatcaactcaacctcttatatttgttttaacaaatatttatacaccctttgtaaatttgcatgagataaagtcattatagttaaaaaaaaattttttttttttgagacagaatcttgctccattgactaggctgagtgcaatgacatcatcatggctcacggcagcctgaacctcctgggctcaattgatcctcctgcctcagcctcctgagtagctgaaactacaggtgcatgccaccatgcccagcttgttttttattttttgtagagacagggtctcactatgttggcaggctggtctctaactcctgggttcaggtgatcctcctgcctcggcctcccaaagtgttaggatttcaggtgtgagccaccatgcctgtcctatgaagtcattacaaagaaataaaattaattggtttcattggcagtattgaatttcaaagcagaaggggtgcttaagagaaataatgcctttggagtaatttctgatgctagatgaaactcatatctcatttaaggtgtccatctgaattttatgtttggatgattgtgaattattccttaaagcttgaagtgaactctggctctctaggataaattaatctttattcctttaatctttattcccttagggatatattaaagggatcaaatttttttttagagtaatgtaaaattaagggacttcttttgttaggtgaatttctcaggttttaagatatcagtatcattgtggacattgactacattgtctactaaattctgtaattttaacttataattctcagtaattggctgggtgcggtggctgacgcctgtaatcctagcactctgggaggccaaggcggcagatcacctgaggtcaggagttggagaccagcctggccaacagggtgaaaccccgtctctactaaaaatacaaaaaaatgagctgggtgtggtggcgggtgcctgtcatcccagctactggggaggctgaggcaggagaattgcttgaacccaagaggtggaggttgcagtgagttgagaatgcgccattgcactccagcctgggtgacaagagtgaaactccatttcaaaaataaataaataaataataaaaataaaaatacaaaaattagctgggtgtggtggcgggtgcctgtaatcccaactactcgggaggctgaggcaggagagtcgcttgaactcgggaggcggaggttgcaatgagccgagatcacgccactgcactccagcctgggctacaagagtgagactctgtctcaaaataataataataataataattcttagtaatttttgcaatttttttggtacctaaaataatttctgttattgtgttggataactttgtcaacttcactttgggaatatctaaatacaggtagctgcattcgagccagaggaatattgggtttttttgttgttgcttatttttgaggcagccttactttgtcacccagactggagtacattggcacaatcatggctcactgcagccttgaccttctgggctcgtgtgatcctcccaacccagcctcccaagtagttgggactaaaggtgtgcaccaccatgcctggctaatttttaaatttttttgtagggatggaattttgctatgtcacctaggctggtttcaaactcctaggctcaagcagtcctcccaccttggcctcccaaagtgctgggattacaggtatgagccaccacacccagttgagaaatactgggttttaatcaagattattgtctgaatattgagtcttaatgacttttttgattttgtttttttggccatagtatgaagtttgctgttgataaccttctgtactaactagaagtagtatagaaactgcaaattaaaaaaaaaaaacccaggtaaaatgttgatggctgctatttttatttaaggtattaataaaggaaaagaagtcagggacattatggaggtcaagttttatattattaaaactcaacttcatgatttatacatacttagaaatagtctgagtgatgtgtgaccaaaatatgatttctaggaggaatgatagttacatccgtggaatagctgcgtacactttattgttcttggtgcttaaactttagttgtcctgctaagataaaggaagacattctttcagttggaaatcatgataatgtatttctccattgaaacagtatggtttgaacagtgctatatattcatactcattattattccttaaatgaatattttaagctcctgatagaaggcaggtactgtgttatatgctgtttgtgttaccagaatacgaagatgaagagaacaaagtattacacaattcctaatctcacataaatgctatttttttttactagctgtggggagcacaaaataagtggttgaaagtcatctgacacagttacatttattcctttccttttccatggctcttaggaataaattgttctactctatggattaaattgccctttgtttattgcctgggatcccaactttatttcctaattttatttctttgaggaaacgtttcacaagttttataacaaagtataactcaatttggagagcacaatctgtgcataagttggaggctacctattgtgaaatggaaaaatgcttgtcctagcattactgagttaatgtatagctggtagaaagttttcacttttaattgctaacttgcctagtgagagtgaaagattgattacggcaactaaaaagtataaaaactactgagtagtttttaggtacagtcagttcttcagtagaacaagaatcttttttttttttttttttgagacagagtctcgctctgtggcccaggctggagtgcagtggcgggatctcggctcactgcaagctccgcctcccgggttcacgccattctcctgcctcagcctcccaagtagctgggactacaggcgcccgccactacgaccggctaattttttgtatttttagtagagacggggtttcaccgttttagccgggatggtctcgatctcctgacctcgtgatccgcctgcctcggcctcccaaagtgctgggattatgggcgtgagccaccgtgcctggcttcactcagtgttttcagttaggaaacttacattgtttagttttgggacattttcttgaattatttcactggttttttttcctctctgttttctcccgtggattccccattgcatagatgctgaattatcttgactggacctccagttttttcttcttgattctgttgccatctctttgattccttattgtttctgataaattttcctaagtttaatttccgagagctctttggaaaagtatcgattttttttcatggatggagtatctactcttttgacacagggtcttgctctgtcgtggctcactacagctttgattgctcaggctcaagcgatcctcctgccctagccctcccagtagctggtactacaggcctgcaccgccaaacctagctaacttttttgatttttagtagacaaggtctcgctgtgttgcccagactggtctcgaactcttaagcgccaagcatttctcttgcctcagcctcctaaaattctgggattacagtgtagtatcttctgtatcctttccatggacgctaatgatggggtataaaattccttttatttatttattttttattgacatcagaaattcctgctaataaaattctttttaaattttaagtttttttcttcccacagttgtccgtgtttcctccaagttccttttctattttttgttttcctttgttttctttttgtggtagatgctttcctcagatgagtggtaatccttggctatttgcagttatgcctctaaaagctgattggaagctcttagtacctcattggtacttgttgactagagttcactctagggtgatctatctgtgtcatttgctggggcacccttcatgtcagcttctgattacttttcccttttctgaaaagggagagaggtcttttaatttcctgtctggtgggaggaggtctgtatgccacttctgtgggagagtgagggaagtagggcagtgaggatttcagtattcagtacatatgtgttttcttaaggcctctgttttcattaagcctcccccgcaccaatgtgctttatgtttccctgctctgaaatcctcctgagggaataatcctctagaattttgccttggtgggaaatgcatagtaacctaaccatgtggtatttaggaaggtactgagagattgagcgtttcctaaggagctttcagccagccttctttatttagtgctcccttcacacctgtttctacaggcgctatctgttaccagttcctgagccttttgaagattccgtggacgaaggttggtttttggctttccatactgctggtttcttggatctgctatgtcagttaccatttatgcatttgctttctagcttttaagttttgtttatgccttaaaaatacctgatgagggccaggcgtggtggctcaggcctgtaatcccagaactttgggaggtcgaggcaggtagactccttgcatctgggagtttgagagaagcctgggcaacatagcaaaacccgtctctactatagaaaaattaacccggtgtggtggtgcacgcctgtggtcccagctacttgggaggctgaggtgggaggatcgcatgagcctgggatgtggaggttgcagcgtgctgagatcatgtcactgtactccatcctgggtgacagaatgagaccctatctcaaaaacaaaaacaaaaaacccccaaaaaccttattagtattttagcacaatttggggaagaaatgaagttaaatatatgtatgttccatcttctctttacccagaacttatttctaatttttttttttgttaagcatcttttttgttgtggtaaaatatacataaaatttattatttataagtatacagttcagtgacattaagtacattcacaatgttttacagccatcactactttctagttctagaacttttctatcacaccaaaaagaaaccccatacccattaagcagtcactccccattccctccctccctcagcccctggaagccacaaatgtgctttttgtttctatggatttgccttttgtggatatttcatataaatgaagtcattcagtatgtggccttttgtcacatgttttcatttaccataatatttttgtggttcatctatggtatagcatagatcactgcttccttcttttttatggctgaataattttcattgtgtggatatatcacattttgtttatctgttcatcagttgatgaacttttgggttgtttctgctttttctggctattgtaaatagtgctgttatgaacactgatgtacaattttttggggtgaacatttgtttttattcttttaggtatatagctcggtgtggaattgctggatcatatatggtaattctgtctttaacttaatgaggaactgccaatctgttttcctcagtgactgtaccattttatattcctattagcaataaacaagtgtcccaatttctccacatttttgccaacactgttttccattaaaaactttttattatagtcattctagtgggtgtaaagtggtatctttttgttttgatttgcatttccccagtaactaatgacattgagccttttttcatgtgcttgttggccatttgtatatattctttggagaaatgtctgtttaagtcctttgcccactttaaattgtgttgtctttgtgttgtagagttgtaagagttctttatacattctgggtactagacatgattttcaaatttagatacatgattttcaaatcttttgcctctagatgttttttacttttttatttttgatccttgaactcatctatattctatggttgtgatgtaatgatgacagaattggtgtcatttgtgtttatttaccaggttatttggaaggattatattttaggtgctctcctctcccccagtaaatggtattacgacacaagggttataaaggactgataagaaattacttaagacagaaagggaagttggcctgcttccaaaatgtggtcccagcagaagtgaagttagttacaccaataactacagtcaaaaagctatttttaaccatgataatgtacttgttgttattaatattaaagattatatttttccaggtgcagtggctcacatctataatcccagcactttgggaggctcaggcggatggatcacttgagctcaggagtttgagaccagccagggcaacatggtgaaaccccatctctacaaaaaatgaaaaattaaccgggcttggtggtgcgtgcctgtagtcctagctacttgagagtctgaggtgggaggatagcttgagcccaggaggtcaaggctgtggtgagccaagatcgtagcactgcactccagcctgggcaacaggacaagaccctgtctcaaaaacaaaacaaaacaaaacaaaacaaaacaaaacaaaacaaaaccgactatatttctgcattaagtgggggtatggaatcctatctaatatttgagataataattgttatagtattttattgagcttttattgggtaccagatgtgttctaagtttttttcgtgaattattttcattaatcttattcattgttgtgtcctgaatgagtactcacatatttgttgaagggctcaatggtccctaaaaccttagatgctgttttggaaggttaacttgccaaaggtcacatagttggcaaatgatgaagctgagattaacattaagatctgattccaaagtagtctttcttaactgtattgctttatgtggagttttgccattgatgtctagacagaaaatctctagcaatggaaaaaaataatttttaattaattttaatttttttagtgttttgcttcttttttttttattttgtgagccaccgtgcccaattggtttcttttaaaagactagttagcttgtgctttaggcctcttgattaatctgaggtatttaattaatatctttgaaatcctaagatttactgtatcacttctgcaatatctaaatttttccttcttacttatttctgttctccttctacagtcctttctattatgtttaatcatcaaaacgttgttcttgttttctattgcaatctaatttttagtgttatgctgtttccagatgccatttgggtcattttcaaaaaaagatgagtaataattagcaagtaatgaatattgttctttttaccattcattaagaacaattgttaattgtcttattctattgtgaagaatatctgtaattcctgcttagaacctgggttgatagcaggatatcaggaagcactaagtgtacacagaacgatatagctggaaaaagtatatatgttaaagaataatatgttgtctaaggacagaatggaactgatcacacaggttcttttttggtaagcttcaaaacttcttatctcccatgaaagtactttttcttttataatatgcaacaataactttctgtttagttaattagttttaaaacaagcttaaacttataatttataaagaatcatatttgctccctatcattgttttatagctggggctatactgacaaataagaaaaataaaattcctgcccttgtggaggagacagttaaaaaatgagacaaatacatttcagatggaaatgaggacaatggaagaagagtagagcaggatgaaggcatgaagggtgactgagatctggtcaatctttagatagtgtaatacgggaaactgctttgaaaagatgacttttgagcagagatcttaacgtactgagggagtgaaccattcgaggtctggggaaagaattcagcttcctcttcagatgtacaaaattacaagatattgccattcttgtaactgaaaacctataaaagcaggataagaagtacggtttctaaaaacccatcgaagagctgaggatacaagggagcctaaatgaaccaactccagaaagtaatcaaactttcatagtggagaagaaacccatggttgctctaggatggaacaaccaaaggaataggaatccaccatagatgaggggaaaggagaaaccagccacatttttttaaaatcagatttttaatggccacgtatgggctggtttgacaggttaggatcctaagaagccctagcaactctggcaccaaagagcaagtatgcacccacactccagctcctacccacagatgttcactgaatgttcaggagtagtaagccaaaagcctgggccagtgatgaactggcatagataatacctgaggcatttggaacctctcccaagtatagggcaaccacccttagaaggcaggattgctgagaaaaatccagcagaggctctccaggctttcagttctggaatgctgcaggcaggggaagagctagagataactctcaccccacactctggcagtccatgttttcagccaccaaggactggggacagggcagaagaggtgagtgaaactgctctaattcatttcaggccttcacagaatgtaaggaagctgccctccagaaggctggctggggaggaggagcagggctgcacgagggcacctgagcttcagaaagcaaggtgtgcgactggagagcaaggagaatctagcaaaccaaactctgaccgtcgcgcttaatgcagagatagagttcctacagttttttttttctttcttttttaaaatataaacttgaatttttgaaacagtttcagatttaaagaaaaattgccaagatagtatggagagttcccataaatgctgcctctagtttttcctatttttatttaatttatttatttttttagtttttcctatttttaacaccttatattagtatggtatatttgttataattaatgaactaatactgatatattttcattaactaaagtccatactttatttacctaatgttttgggatcccatttagctgtcacgtctccttagggtcctcttggttttggcattttcttagacttgagcttctcatctcttgtttttgatgactgacagttttgaggagtattgttcaggtattttgtagaatgtccttctattgatatctgtttggtatttttgtcattgttacagtgaggttttgtatttttgggacgaagaacatgcaggtgaagtacaatttgctttcctttttttgagacagtgtctcactctgtcacccaggctggagtgcagtggtatgatgacagctcactgcagccttgaactcctgggctcacatgatcctccctccttagcttcctgagtagctgggactacagatgcatgccaccacacctggctaattttttttttttttttaatagagacagagtctcactgtattgcctaggctggtcttgaactcctaggctcatgcaatcctcccacttcagcctcccaagtagttgggactacagacatgtgccactatgcttggcagtaccattttcatcacatcatattaaggggacatactgtcaatatgactaatcagtgttgatattgaccttgatcatctggttgaggtagtgtttgtgtatttctttactacaaagttactcttttttctcctctgtttacatactgtactctttggaaggaagttacatatgcgcagcctacacttaaggcatggggagttatgatacccctcctcaagggcaaagtgtctatataaattatttagatttcttctgcatggaagatttgtctcttcttcctcatttatttatccattcaattttttaaatattagtatggacttatggatattttataccttgggttaaaatcttattattgctttatttattttattgttcaagttgttccagctttggccactgggagctctttcagttggtatgactttttgatataccactgtcagtgtatgtgtgtgtatgtctgtttgcactttctcactttctggcactacaagatgctctagtatatttagagactaaagcatgtagtatatgctttagtatatgctttatctagtatatttttctgtctcaatcctagaattagccatttctccatggagccttggttccttttactggagaatggagaaaccaagatctaggtgctaggtgtacatgttgctactggggtgtttttgcttgtaggccatctcagctgacagagccagaaaatgtatgtatttatactaccctgtatatatccacatatctataaatatttctatatgtatccatccgtatctaattaagctaaacatgagtttatattgatgtattaggttccagttgaatcactacatggatgattctaacttcctgcccttgcttatctgaaaactcctgctccaatagtgagaaatctgtctcctaccatcagccacccatttacttaatcattctactctagtatacatgtaaggtactcccacagttttaaaaactggtggcttggctatgaaacacaagcaggtctctgtaattttacctaggctcagatcccagacctgctcaagtgaaaggcttgatctcagtccttaaatatttgaagccagtgattaactgttaaattaaagctgcatcatagcccacacccagctcagttacatattggattgactcagactcccttctagtgtcctaacagaaaaattgtcatgtctttttctggaagtaaaatattacttaatttaataagtaatctatttttatataaaatgtctggtgtgtaatgaaaagttacaaggcacaagaaaagcaagaaaatgtgaccaaaggtcaagagaagaaatagtcagagatgatccagatttatcagaattatcagacagggatttaaagataattatgaaaaaaatgctagatgattgaatgataaaggttaacgatatgcttgaaaagatggggatttctgtagagtcatggaaattatgccaaagaaccaagttgaaattctattaaatagaggtgaaaaatatactagcagagaccagggaaaacaaaaaaaggaaagaaaagaaaaggaaagggaagggaggggagggaagggagaaagaaaaatacactagcagaaatgaattcattacatgggcttaacagtttatggacatagcagaagaaagaatcagtgaatatgaagacagattggaaagagaaaagacagaaaaagtcagggaggggtagaaaagagattttagatctgtgggataatatcagatggtctaacatatatgtaattggagtttcagaaggagagaagagaacgtggcagaagacatatttgaagaggcaatgctcaggaacttctaaaattgatgaggtcatcaattcacaaatggaggaagttcagcaaatcccaagcaagttaaatacaaaacaaaaataagccaacaaatttaaaaatcccatatataggcatatcataatcaaactgctgaaaactgaagatggaagagatcttaaaagcaacaggagagcaacaggagaataaaagacacattagttatgtgagaatggcaacatgggttatggctattccatgttttagggccagaaaaaaatggagtcttagctgagcatggtggcacatgcttgaacccaggagttcgagtccagcctgggtaaagtagtgagaccccatctctatttaaaaaagaaaagaagtccaggcacggtggctcacacctgtaatctcagaactttgggaggtgggcagatcacaaggtcaagaggtcgagaccatcctggccaacatggtgaaactgcgtctctactaaaaatacaaaaattagccgggtgtggtggtgcacacctgtagtcccagctactcgggaggctgaggcaggagaatcacttgaacccaggaggtggaggttgcagtgagccgagatcatgtgccactgcactccagcctgtcgacagagcgagactcagtctcaaaaacaaagaaagaaaagaaaagaaaaaatagaatgttaaatacaatgggatgacatccataaagagctgaaagaaaaaaaaaaaacaacctgttaacctagatttctatggccagcagaaatagccttcaaaaataatggcaaaataaagactttttggacatatcaaaaagggaaagaatttgtttccagcagacctggactcaaaaaacattaaaacatacacattaacaagatgtgggttttacagcatatatgtgattatacaaccatgaaagaacaaaaaggaggagatggaattatactgtcacacatttcttactctgtgaaaggagactgtagtaacttctggatgcatatgtaatctctagaacaagcactaaaaacacaaacagggataccataaagtcagtacatctgcccaagagggattaactgctacgagaatcattctcctactgtaaacagctagaaaacaggacaaaaatacatgaaacaactgttttcagacattggacaacaggcagcacaggatagtgatccctgagagaagggaaataactgatatgaaccctacaggggttcctataggcagtttccagattgtagcacagagtaggggaatccaaatagagcccaggagagtttggagaagtcaaggcaactagaatttgtggggcagaaaacaagaataaaaggaactacacagaaatctatagaagtaagagaatctttgattggacactcatctgcacatgtgaagtgtggaagtcagcaatgctggagaaagtcacactggaaatcagaacactgaacaattccaggagctcacacagagctgggaatagtttatgtttccattaggcatagtggagagactgtttcatacaaaggacattggctagagtcttcaaagtggggttaaattagctatagactaaaggcctttctaaacctaccctaagcttcaaggcaggttttgaaaggaccaggctgattctaagtaactcaattatgtgccaaaactaaactcttttaaagaatacagtaaatgccagcacctaacaattaaaatgttcagcattaataatatattaatgaaagattactaggcatacaaataaaaagcaggaaaatgacccataaccaggagaaaaatcaatagaaaagagacctagaaatgtggaattattagaaataattctgatgattgaattatcagccaaatatgttaatacaagtattataatgactagtagagaaatgaatgatagataaaaagacacaagccagatgtggtgaatcatgcctacagacttgagggtaggcagatcagcttgcccaacatggcaaaaccctgtctctactaaaaatacaaaaattagctgggtgtggtgggatgtgcctgtaattccagcttgggaggctgaggcacgagaattgcttgaacctgggaggcagaggttgcagtgagctgagaacatgccactgtactccaacctgggtgacggagtgagactttgtcgcaaaaaaaaccaaaagactcacaagtagtatctaaagatgaaaaataccagatataatatccaaaactgggggaaaaactggatgtgattaacagcagattagacactgcggaaaaaaagatcattaaatgtgaaggtatagcagtagaacctattcacactgaagcacaaagagaaaaaaaatactagaacaaagttaatagaacatcagtaaccttgggacaatagcaagttgcctaatacatgtataattggagttccagaaaagtggggaaaggtagaaggcaattactttaggaaacagcgtctgggtggccaggtgggtggctcacacttgtaatcctagcactttggggggccgaggggggtgcagatcatttgagatcaggagtttgagaccagcctgtccaacatggtgaaatctcttctctactaaaaatacaaaaattagctgggcttggtggcatgcgactgtaatctcagcttcttgggaggctgaagcatgagaattgcttgagccagggagatgtaggttgcagtaagccaagatcatgccactacactacagcctgggcaacagagtgagaacctatctcaaaaaaaaaaaaaaaaagaaaaagaaaaagaaaaagaaaataagaaaatagtggctcatcatggtggctcatgcctgtaatcccagcactttgagaggctgagatgagaggattttttgagcacaggagttcaagaccagcctgggcaatttccttaaaaaagaaaaagaaacagtgactataaattttccaaatctgatgataaccataaactctcagatccaagaaactcagtgaactctaaatagaataaacaaatataatcatacctaggtatgtaatgataaaattagtgccagtcatggtggctcatgcctgtaatcctaacactttgggatgctgaggcccggagtttgagaccagcctgggcaacatagtgatacccctatgtctacaaagattaaaaaatagaaatataaaaagttagctaggcatggtggcacttgtctgtaatcccacttacttgggaggctgaggtgggaggattgcttgaactcacgaggtcaaggctgcggtaagccataattgtattccacccagggtgataaagcatgacgggagatcctgtctcaaaacaaaacaaaaccaaaaaaaggcgaggcacagtgactcacacttgtaatcccagcattttgggaggtcaaggtaggatgatcgcttgagcccagaaattggagacaagcctgggcaacatagtgagaccctgtctctcaaaagaaagtttaaaaaggcgggcatggtggcatgggcctgtagtcctgtctactcaggtggctaaggtgggaggattgcttgagcttgggaggttgaggctgcagtgaactgtgttcgtgccactgcactccagcatgggagacagagcaagatcctttgtcaataataacacataaaccaatgttacaatgagaagaaataaattctggtgttcggttttttgttttttttttttctgagatggagtttctctcttgttgcccacgctggagtgcaatggcatagtcttggctcactgcaacctccacctcctggattcaagatgattcttttccctcagcctcccaagtagctgggattacaggtgcatgccaccacacccagctaattttcgtatttttagtccatcacgttagccaggctggtctcaaactcctgatctcaaattctggtgttctattgcacagtggggtgagtatagttaagagtaaaatattattacaaaatagctggaagaggggcttttgaatgttctttcacaagtgagaaatgcaggaggtgatggatacactaactgctctgattggatcattatgcaacatggatatgtatcaaaacatcaaattgtggcccggcgcggtggctcatgctggtaattccagcactttgggagtctgcggtgggtggatcacctgaggtcaggagttcaagactagcctggccaacatggcgaaaccccatctctactaaaaatacaaaaattagctgggtgtggtggtgcatgcctgtaattccagctactcgggagactgaggcgggagaattgcttgaacctgggaggcagaggttgcagtgagctgagattgcgccatcgcactccagcctgggcaacaaagcaagactccatctcaaaaaaaaaaaaatcaaattgtaccccataagtatgtacaattacaatatgacagtttaaaaattaaattaaaaaaaaattctcttgtacttaccagctgaataaaaaataaatttttaaaaggagagaagtcttcttaaaaaccagttatttaccccatcattaagttataatgaactttcttatgggaattctttgataaggaagctcctttatgctgaagttttattcttttcatacctctttagataaatcagtgctttaggagcatatgtcatatgactcaatggcagtgttctaacttggattctagctccacattgtgcaaaggcaaaaaaccagagagtcagtgtggtagttaagaacttatgttctgctgtttgatttcctacatgccagtactccctccactacctgcagtcttcctgacctggggcaagttccttttgtaaactctgttttctagggggatggtggtggaagaaggatggtgatttgagccaggcagtagcaggtagaggtggagaaaagtggtcaaaccctgaatgaacgttaaagataggaccaaaaggatttgatgagaaattggaagtagagcacagggaaaaagaaagatatcagtgatgatgccaaggtttttggcctggggaattgggatagtggagttgttatttgctgagtatgacttttcacaaaggaatgtcaaggcataagtagcaaagttcttttttttttttttttaatttttcttgattgtgtttgttttgtttttcatcttttgtgggaggtgggtggagatgaaagcaagcacaggggttggcaggcatacccctggcacctacctgtgagttcatgattactagttttaaagttcagtcctttttatttttacttttttttttttttttttttttttagagacagtgtctcactctgtcatccaggctggagtgcagtggcacaatcacggcttactgtagccttgatctcccaggctcaggtgatcctttcacttcagcctcctgagtagctgggactacaggcacataccaccctacccagcaatttttttaaaaaattttttgtagcgacatagtcttaccatgttgcctagactggtctcgaactactgagctgaagcaacctgtctgcctcagcctcccaaagtaaagtactgtaattacaagcttgagccaccgtgcgtggccaaattctggccttttgatgttgcatggtgtggatggggaggcaaagtgtgatattttaggaatttgaggatttcttcttcgaccttaggcgtgacattggacaaatgacatctgggctgagacattttctagtaatgctggatccaaaaaactcttatcccattgtctcatagcttcattacacagacctggcggccatgatcctctttttttcccccttagttgccaaacatgggttctctgtcttacctcatttgagtcttacctcagtcttgagagtctcaaatgtgtatcatagtttttagacaaaattcaaccttatttcaattagtatttcattgttatttaaatattttaacaggaaaactgagcaatgtttccctttacctgttaatcctgttataatattttagataaagtgtattagaaggcacattcttcattaatagaatatttattcatgtgtttatatggttcttaactaggaataccatatagtctatctccaaccctttgagaaggaaaaaagatcctgactaaacaggacaccagaagggcatgcctaaactaggactgttctgggcaaatcagaaggcatgttcaccttattctttttattctttctttttctttttttttttttttttgtgacggagtctcgctctgtcgcccaggctggagtacagtgacacgatcttggctcactgcaacctccacctcccaggttcaagcgattctcctgcctcagcctcctgagtagctgggactacaggcacatgccaccatgcctggcaaattttttgtgtttttagtagagacgggggttttgtcgtgttagccaggatggtcttgaactcctgacctcatgacctgtccacttcggcctcccaaagtggtgggattataggcatgacccactgcacctggcctcaccctattcctaaggccagaaaaccagctagagtaaagttcactttctgtttgagtgcttggactttattgggagaaggcaaatgccctggaacaagagtgaaagggagaaattcccgttgtattgcaagccagaataagagaggctcacccacactggcctaaggcatctcagttgttgatgagaatgtgattacagatgtctcacatgaataccaaagacaattgcaaaggaaattaaaagttatgcaaagagagtcgagaagtcagttgtctgctcacaggttggctttagtggctattactttgagatactaaatgagcgatagctttaaacttcaactgcttttgtttctgaggaaaaaaatcatcttatatcctttcataagtcgcataaaaagtggacattttctattattttaaagagtaaatttaggtacaagcatttactaatttttttttttttttttttttttttttgagatggagtctggctttgttgcccaggctggaatgcagtggcgcaatcttggctcactgcaagctccgcctccctggttcacgccatgctcctgcctcagcctccagagtagctgggactacaggcgcccgccaccacgcccagctaattttttgtatttttagtagagacggggtttcacccttttagccaggatggtctcgatctcctgacttcgtgatctgcccgcctcagcctcccaaagtgctgggattgattacaggcgtgagccactgctcccggcctgtaattctttttttttttgagacggagcctcgctctgttgcccaggctggagtgcagtggcgtgatcttggttcactgcaagctccgcctcccgggttcacgccattcttctgcctcagcctcccgagtagctgggactacaggggcccaccaccacgctcggctaattttttgtattttttagtggagacggggtttcaccgtgttagtcaggatggcctcgatctcctgacctcgtgatccgcccgcctcagcctcccaacatttagtaattcttaaaagagttcagcatgaatatacacagtacgtgggttattagtactgtgttgttaacacaaatgaactatgatagcaaattgaatttggttcaatcaggtcaaagaataaaaggatgattttctttaaccaccagcaaaggatagtataatgaaccccatgcaactatcacttaacttcaataatttcaagtttgagtaagttgcagagtagtaatttgaacccacatctctcttgttccaaatcccttgcttttaattacaatcccatgtggcttctttgtcatttgatgctattgagcaactttatgatttttttggtgtttttggtaaaatagacatgaaaaggcattactacagggagttttttcactccctggtaataagaggggaaaagcactctcttttaatgatacatgttttgtaataagcattttttttagttgcagtgttctgcaaagacaaaacctgctgatacagttcatcctgttttagaaatctttgacccattcatcagactctgaccactctaaagataaaggattatggttgtattggtttttccgactgaagcggccttctgcagattgagaaattgtataattattaactgcggtaatggagatgtacttgcaagtttcatctggtatcttaatgacctttaaccctctgagtacacctaaaacatatcctagaattattgaaattaatcagttgtccataacttttctgtctgtataatttggctatcatacgtattttgtttccccctgcccttgccagtttccatcctcctactcacatactcacaactcctataaattggagtatttagtagcagtagcctttggtataaacactttttaaaaatttactattttttgaattaatagggccactttctagtcaagtttttttttttttggggggggggtaaggagggtagggtaacagttccacacttacaagggtatttgtttagaccaagcttgttcaacccacagcctgtggggctgcatgtggtccaggatggctttaaatgcaactcaacatgagtttgtaaactttcttaaaacattatgagttttttttgagaatttttttgagacagagtctcgctctgttgtccaggctggagtgcagtggcccgatcttggctcactgcaacctccacctcctgggttcaagcgattctcctgcctcagcctctggcgtagctgggattacaggtgtgtgccaccactccaagctaatttttgtatttttagtagagacggggttttaccatgttggccaggctggtctcaaactcctgacctcaagtgatctgcccacctcggcctcccaaagtgctgggattataagcatgagccaccgcgcccagcctgcgatttttttttttaagctcattagctatcattagtgttaactgtattttatgtgtggcccaagacaattctccttcttccgttgtggcccagggaagccaaaagattagacacccctgatttagacaaataagtgaaggcacactgaaataacagttatatataataaccttgtgccacccagcgcggtggctcatgcctctaatctcagcactttgggaggctgaggcgggcggatcagctgaggttgggagttcaagaccagcctgacttacatggagaaaccccatctctactaaaaatacaaaattagctgggcatggtggtgcatgcctgtaatctcagctacttgggaggctgaggcaggagaatcgcttgaacccaggaggcagaggttgcagtgagctgagatcgcgccattgcactccagcctgggtgacaaaagcgagactctgtctcaaaaaaaaaaaaaagaaaagaaaagaaaaaaaaaacacaaaaaaaccttgtgttttgtggatctcacattcatctcagatatttcttgccctgggagatcctctgaattctcaggactgcttcgtgtcatccctttatgctctactatcttcccttgcctagaaggcaagtagggctttgaatctcgcctttgattctactgtgatcctatcaaatatagtaatgctagaaatataggtctgaagtttgggagagagattggctcagtatagatatgtaaagcacagctggatatgtagtagttatatgaatgggattggatgaaattctctagaggtgtgtggaatggaaagaggtggcccaaggaggaagagagagagagagaaattggagaggtagaacaatttaggaaagagtaatgttctagaaactaaggagagagtttcacaactgcagtggtgaagcactgtgagttcttatttggcaatttggacttcattattgtcttatcacagataggaaatgaaaggttgcagaacatttaggagaaaatattaagtgaggacacagaagcagtaaatgtcgtatatgccttttaaacattttggagattacccatagtaggcctgtcccttgggtaaggcaattagggcagctttcctgggccctattttggggtggggaatgactcggggactttattatatgactttttttctgaacattaataaaattcagttccaaaattttgtgattaactgtagtcctaagagcctatgaaaaatgcagataatgggcagttccacattggttgaactgccccaggcttctctcttctagagatgctgtcccttccttttaatcctgtagtagctcctatcacttttttttttttttttttttttttgagacagagtcacccagactggagtgcagtggtgtgatctcagctcactgtaacttctgcctcctgggttcaagcgattctcatgcctcagcctcctgagtagctgggattacaggtgcgtgccaccacacctggctaattttcgtatttttatgggattttaccatgttgcctaggctagtcttgaactcctgacctcaggtgatccacctgcctcagccgctgaagtcctgggattacaggcgtgagccaaggctcctggcctcctgtcactttttacaattgtcagtttgtttttcctctcagaaattaagctccttaaagctctctattattgttttgaattcccagggcctagcataatgcccagcacgtaatgttgagtgtttgttatgtgagtgattgaaggaataatccaatacatatctgtcttaagtacaaaagaattccaatatggtggtctcacagagtcaaaaaagcggaatgtttcagaaaagagggattgataaacagtttcaaatggtactaaaagtattgaaaactgacctttggatttggcttctagaaggtcattggtttccatagtgaaaacttttatagcaaaatggttggagtagaagtggttgaagattaaaggagaaatgagatgtaagaaacaacaaacaagtttgtgggggcgggggggttggttttatttttaaagacttgtagctgagcgtgacagtatgtatctgtagtcccagctatttgggaggctgtggctggatgatagcttgagcccagcagcttgaggctgcagtgagccatgattgcaccattgcactccagcctgggtgagagagagagaccctaactcaaaaaataaaataaaataaaataaaataaaataaaataaaataaagatttgaagctaaagggaagaaaccattggagaagaaagccaaagatctgatggaggagaattcattatcatggtaatgttatgcatttgatttgcatatatctaagtattcccaccaacatgttttttttttttttttgagacagagtctcactctgtcacccaggctggagtgctggagtgcagtggcacgatcttggctcactgcaacctcccgggttcaagcgattctcctgcctcagcctccctagtagctgagactacaggctggtgccatcacgccctggtaatttttgtgtttttagtagagatgaagtttcgccatgttggccaggctggtctcggactcctgatctcaggtgatcctcccacttcggcctctcaaagtgctgggattacaggcgtgagccaccacgcctggtcccaaccaacatttcaagataatatatttctccttccacttgggtttgatatattaatgtattttgaacttgaaggcttttgctgtgctatttggggcccctagtggtaaatctaataatgacatgcaatagaacagctaatataccagttattccttatgaaggttattctttctatgaggattaaatgaggttggaatatgtagttatagcaatagtagtgattcttaatcatttttttaaaaagagagtctcgccaggcacgttggctcacacctgtaatcccaaaactttgggaggccaaggtgggtggatcacttgaggtcaggagtttgcgaccagcctggccaacatggtgacaccccatctctactaaaaaaaactaaaattagctgggcgtggtggtagacggctgtaatctcagctactcggtaggttgagaattgcttgaacctgggagacaggaggttgtagtgagctgagatcgcgtcattgcactccagactgggtgacaagagcaaaactctgtctcaaaataaataaataaagggtctcactttgttactcagactgaagtgcagtggtgtgatcatggctcactgcaatgtccgcctctcaggctcaagtaatcctcccacctcagcctccctagtagctgggactataggtgttccaccactatgtccagctaattttaagaaattttttagtttttaaatttttttgtagagatggtggtcttactatgttgtccaagctggcctcaaactcctggtctcaagtgatcctcccacctcggcctcccaaagtgctgggattaccggtgtgagccaccatggctggccaaaaatgagtaatttttttttttttgagatggagtctctctttgtcgcccaggctggagtgcagtggcgaggtcttggctcactgcaacctcctcctcctgggttcaagcgcttctcttgcctcagactcccgagtaactgagactataggcacgggccatcacagccggctaatttttgtatttttagtagagatggggttttgccatcttggcctggctggtcttgaactcctgacctcaagtgatccacccccttggcctcccaaagtgctgcgattacaggcgtgaaccactgtgctctgccccaaaatgactaatttaaaggtgactgtaatatagttaaacaaatgcctcttttcccattctttactaacttgttatttaaatggggcaagtttttacaacataagaaacaggccaggcgcggtggctcacgcctgtaatcccagcactttgaaaggcagaggcgagtggatttcttgaggtcaggagtttgagaccagcctggccgacatggtgaaaccccgtctctactaaaagtacaaaaattagccgggcatggtggcacagactgtaatcccagctaatcagggggctgaagcaggagaattggttgaacctgggaggtggacgttgcagtgagcctagatggcaacactgcagtccagcctgggcaacagagcaagactccatctcaaatgaaacaaacatactaaaaacctattaacttgtttgatgtgagtgtgcttagctttatttcccttaaagagagtctttttatgagatggagtctcactctgttgcccaggctagagtgcagtggtgcaatctaggctcactgcaacctccgcctcctgggttcaagcgagtcttctgcctcagccttcaagtggctgggactacaggcgtgtgctaccacgtccagctaattttttgtttttagtatagacggcgtttcacgctgttaggcaggatggtctcgatctcctgacctcgtgatccacccacctcggcctcccaaagagctgggattacaggtgtgagccactgcgcccggcctaaagagagtctttaggtgaaaaatttttgtgaatattgtgatttctccttaataatttcttgtgtatttatgaattttatataattaaatggcatatcaaaaaaatcacctatgttaattatgtttttgactcagttatattttcttttggtacattattaagttaatatccatatgcaaaaatatgctgacaatatattaattttggatttttcatttttatcagaaatcatgagtggaggatctcaagtccacattttttggggtgctccagttgcttcactgaaaatgacagtatcagaagacacagcttctttaatgtctgttgctgacccctggaaaaaaattcagcttttatacagtcaacattctttatatctgaaggatgaaaaacagcacaaaaatcttgaaaactatgaagtcccagattctattggttctccagatctttgtggtcatttcttagcaaactgtatgaatagacatgttcatgtgaaagatgactttgtacattctgtttctgaaacacagaatatagaatcccagaagattcactcctctagactgagtgacataactagctctaatatgcaaatatgtggatttaaaagcacagttccgcatttaaccgaagaagaaaagtatcaaagcttctcagtgaaaataaaattagagatgaacagcctaaacatcagccagatatatgtggtcagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaactcagtagataagtcaaggtctgaagcagcagttaagaaggtctcagaccttaaaatatcaactgataaagaatttctcagtataattacctccagccaggttgctttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacatattgagttgtgtagctcaggaatactgtgttcccaactaaataccttccacaaaagtgctattaaaagaagctgtacctctgaagataaagtgggccagtctgaagctctatctggagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacaaaattcggaccaaattctggctctaaagtgcctttagcaacagttacagtaagtgatcaatcagaaactaagaagaaggtttttctgtggaggactgcagcattttgggcatttacagtgtttcttggagatataattttactcacgggtgaggtcattatggtatagtggtagcttattttataaagctaagttttgtttgtttttgtttttctcccacttagtctttgaagactctttctttagtcatttgcctcttctgagctcagcataattgatccctttattgcatctgcattgctctcctttccattgtccactctcctgcccattgccacttctgggcctctgttctatccttctcagctctgccccttctttccacttatcccctcctttaataagccttccctagtcaggtggagtgggtcacacttgtaatcccagcactttgggaggctgaggcaggaagattgcttgaggccaggaatttgagaccagccttggcaacacagaacccgtctctacaaaaaataaattaagttttgcgtgcctgtagtcccagatacccaggaggctgacatgagaggattgcttgagcccaggaggttgaggctgcagtgagctttgattgggccactgcactctagcccgagcaacagagttagacctttctgcttctttacctaatgtctaataatgctgtgcacattgtgtttttactgtgggaacagttattgatttctgttgccttattttattatcaaaattatattaattacacttggaaatatggaaaggaaaaaactggtattataccaacttcatataaccaccaatagagttcgagagtgttgccttccagttattttctctgttctccttaaaatgtgtgtgcatgtgtgtatatatcacacatagaagctcatatttattgggagcttagtttgtgagaccctgttttagattttacatgcatatttcattacaacaagtatatgaggaaggtactgatttttatccccacttttcagttgaggaagctgaagcccagagaagtaaagtaacttgtccaatgtcatacatctaggaagtggcaaagctatagtttctcctagactccagaatttatactcttactatatagttgtaaccataaagaacattttgtttttttaatttttaatttatttatttttaagagacagagtcttgctatgttgccaagtgcagtgggtactcacgggcacaatcccattactgatcagcatgagaatttttgaattgttatttttaattttttgtttgtttgtttaataaggacaggatctcactgcattacccagtctgatctccaactcctgggctcaattgatcctcctgccgcagcctcccaaagtgctaggattacaggcgtgagctaccgtgcccatggtatttttaacatgcccttgtttccaacctggaccagttcacccctccttagggaacctgtggtcctccactcccaggaggtcactatattgatggcaagcttagtgcaaacacctgatcggctacaactctgaactcctgggctcaagtgagcctcctgcctcagtctcccaagtagccaggactacaggcacgcatgccgctgcacccagagagaatatttaatttttttttttttttttgagacagtcttgctctgtcacccaggctggagcgcagtggcacaatcttgactcactgcaacctccgcctcctgggtgcaggtgattctcctgcctcagcctttcgagtagctgagattacaggtgcaagccaccatgcctggctaatttttgtatttttatagagacggggtttcaccatgttggccgggctggtttcgaactcctgtcctcaggtgatccgcccacctcgccctcccaaaatgctaggattacaagtgtgagccaccgtgcctggccagaatatgttttcatcgaacacatctaacattgtgttacgtgttctttgttgatttaaaattgacacatggtgtattagagcaggaggaagttgattaagcttaataaaatatctaaagaaagaatgtgatacagaggcggtatttagaaaaagaaaacttcgaagcaatattgatagtcctaccaaatagtttacaggaggaatgagaaccttagctaatgtacttggtgttcctgtaggattgtcaagtacaatctttttttttttttttttgagacggagtctggctctggcacccaggctggagtgcagtggcgcgatgtctgctcactgcaagctccgcctcccgggttcacgccgttttcctgcctcagcctcccgaatagctgggactacaggcgcctgccaccgcgcgcggctaatttttttgtacttttagtagagacagggtttcactgtgttagccaggatggtctcgatatcctcacctcgtgatctgcccgcctcggcctcccaaagtgctgggattacaggcgtgagccaccgcgcccggccgagtacaatcttttataaagaagtaaacacaaaattgtaatgaacaggcttagcatagccacatcccactggcagtattagctaatattatttatatgtgattatattattggaggttcaattcacctaactccctctgttctgattcagtgcttgctgaatacctctttgcttgtgatttggctttctagttgtagagctgcccacagcatgagaacaggctgaaatactgtttttttggggcaattattgtaaatgaaaaaaaaatgtttttttttctttaatttgtttcattaattgatttagtatgagcttatgttgcagagctgaaatctagttttggagtgttaacaaaattaagtttcccagactgtaaaagagggctggatcctggaccatggtcattttaccgaggcaattaatgtcagcagggacctctcaggggccttttcctttttcctaggtaggtgtaaactcaactctgcaatctctgtattttttcctaacatctctatagttgttaacgactaggtaacattctctctggtggctgtaatgcaatttacttaaccattttcctattataagacatttagatgatttctatgaacatttttttaaaaaatcagattttttttgtctttttaagaaaaagaggatctagttcaccgatttctgaataagtttcttttgtgtggaacagatggaaatgttgggaaaaaaaagaaatctacacttttctgttgtcctaatgaggcagtgaacttagttggatagcttgggtagtttatactacctattgatatatacccccaaacagaaatcttcctttttttttttttttttttgagatggagtcttgctctgttgcccaggctggagtgcagtggcgtgatctcggctcactgcaacctctgcctcctgggttcaagtgattctcctgcctcagcctcccaagtagctgggactacaggagcccgccaccacgcctgactaatttttgtatttttagtagaggcagggtttcaccatattggccgggctggtctcgaactcctgaccttgtgatctgcccacctcggcctcccaaagttctgggattacaggtgtgagccagcgcgctcggcccatactgaaaaatttgaagtaacagatgtattccagaccttgttgaataccaacacagtagacagtttgctattataacttctagcaatagaatgaagagatgccaaaaataaggattacctaagggagactactgactagaattagaagaagatgggaggcttaacattgggaaaccacagtgtttaaaggacaaacagaataaggactaggagctggggcatgtcagtgagagggtaggaaggagccaggaggccagggtgggctacccatcccctccatgcaccactagtgattaccatgtcactaatccaacataggcttcacagtcctagctttcagaatgctctccttgaaatttcttgtctgttccttttttctgaagaacatgcatcctgaatgttggatcatgaaaagtcttgaatgctgtactagctcttcctggctaggcagtggggaaccactgttttttagtaagtcacctgaactcattaatgctctgatatatcactcgcctgaactcattactgctctgataaatgactcattagcattgtaagaaatgggttgcaggcgggacaagcacctgttgggagggaaaggaatgtgtaatgtaaaacagtagtagtggtggggcatgggcacatttaagcagcagaggggtaggtgggagctggtggcaaggagtgggaagggagaggcaagatgacttcagattttagtttacttgattagcagcatagcatcaataaatgagttgggcgctatgaaaggaaaagcagatttggacattgctgagtttggggagccaatggaatatccaggtgggaatttccattaggcagttgtagataaaaggttcaaaagctgaggaaagggtctggaatctaaatctgtaagtaatcacttggaatttatacatccttggttttctttcctattatctctaaattatttcactattgttaatatatgtttatacctctgacactgtatgctgattagatcctgccttagagatagctcccttcccctctttctctttacagctcacatgttttgctctacctacaattgtttctacctgttggtatgtttagttctacctgattctactctatccgtcttagatatacagctctctctttccaattggaaaatgttccctacctccaaagtctttcacttttaacttatgtggaagataattatcgtgctatttagggaaaaataatcaagtgtgttatattcagatatatttatagtagaagggaccagtgcatactgaatattattactctcctaggcactacggctttggaaccactactttgccttctggtcctaaaaaaaattatttttgatgtatcagaaatatacatgataacattttccttatgtaaataaaaactattaaaccttttttatatagagcagtggacttccatactgctatcatttgaatataaagaagaaattttgttaatttacctagatttagattttagatttgctgttttgtcatttcgtgcccttaggcaggttatttaacctatttgatctctagttgcttggtatatgggaggcatgcataatattttgctgtgactagtaggttaaccacattgtgaaggaatttatggcatgatcagaatgttttttctctctctagatgttgttattcatgaggaccaatggattggtgagacagtactacaatcaacatttagcagtcagttattaaatcttgggagttattcatctattcagcctgaagaatgtaaggcacattttaaatgaagtaatgtattagtgtttaaagtataaaaacatactaggaaagattagggttaaaatggttcttttacaaaatgttttctaaacagttggagagtattggtttcttttcattagtaagaatgaaaatagaattttaagaaatgaacttgtacattgtaaatcacatttattttaagaagtattgggtctcatgtttcgttttcttaggctgtcagtatagtggtggttcttcaccttttagggagtcagagacctctttgagaatctatagaccatttctccagaaaactggacttatgtagataggcacaaaattttgcttataattctaaagcattccgtggacctctgaagttcttctgtggaacttctgagcctctgattaagaatccttgaggtaataaaaatgtattggtctcgtattcagacagctgtggtttgaatccttattctcctgtctaccactgctaagaaaagctatttttcttctttaatgtccagttttctcttctttaaaagaagctgtttaatgaggaaactagcagctatctcctcctctaggaaataaaataacataaaaaaaaagaaagaaaacaaagtaagggaaacagtataaacttgtggttttggtcactggactcagatagaccaggatttgaatcctggccctcttacttccagtctttgtctttaggcaagttatttcacttcactatacctttatctccttttctttgaaatggagataaaaatacatatataccttatagggttgttatgaagattaagtgagaaaatgaatataagatgttgaacctgcacataatgtagtagtaacatagtaatattagagggagaaataataagctagcaaaatatatttgataaaatgctgaaatatcatacaagaaaatagctagagaaatatactgattatacaagaagataactggaataataggaaagttataggatgtatatggaagatagagcatggaattccaatctttgaattcttaaagaaaggcagagcaagtagaagggaagagcaacaattagaataacaagaactgtgtttgggatgggcaaggtttcattatatactagggtggcccatcagcagaaaaccaactctgacatatttcatagacaactcaaatagagttcttcatctatccaatatatatttattatgtgttgacattgtttcaggcactgtgtttactgtacactgggggtacaatggtgcctgtcctcctggagcttatgttctcatgtggaagacagaccaaaaaaaatgaatgaaacagacatataagtaaaatatttgcaggtgataatgagtgctatgaaggaaactaacaaagggttaagatacagaatgccatggttctagttgagaaggattgatcatggagtagaatcagggttaggaagttgttacaatagctgcagttgagagataatgggaggccagtggagctaaagagccgagatatatttgtaaatagagttaataggattttctgatgatgtgggtctggggatcaggtaagagggacaatctactgctactggattactggtttaagtaactaggtagcctttattgggaaagactgagagggaactggtttgtggggaaaagggctatgtttcaaggcatgttaagttttagatatctttgagatattcaagtggagatgtcatataagaactggaaacaaagttcaggactcagaagacaggtttaaaattaagaggcaaattttagagttattagcatacagataatatttcaaatttaaaagtttttaaaataaatattatctgtataattatagaatcacaggggattgcaaaaataatacataaagtcccatgaactcttcttctagcttctcccaatggtgatatcttatataactttagtacaatatcaacaacaggaaatcaacatttgtataatactgttaactagtaatatactaggatactttccctttcagtatcaataaatatagtatcagcctggcacagtggcttatgcctgtaatcccagcactctgggtggctgaggcaggaggattacttgggcccaggagctcgacaccagcctggatgatatggtgaaacctcatctctactacaaatatggaaaaattagccaggtgtagtggtgcacacctgtagttacagctactggggaggcttaagtgggaaagaaagttgaggctgcagtgagccatgatagtaccacagcacttctgcctgggtgaccagagtcagaccttgtctcaaaaaaaatttttttcttaaataaataaatatagcatcaatacagcattataatatgattaatactatatcaataaaatagatacttagtcctaatgccaatgtcttatttaatagaaaagcactcgaggcattgtcattaaaaccaggaaaaagataaggatgtccactatctctgcaactattcatcttatactagaattatcagctaatgcacttagacaagaagaggcatctggtctggtgcggtggctcacgcctgtaatcccagcactttgagaggccaaagtgggcggatcacttgaggccaggagtttgggaccagcctggccaacatagcaaaaccctgtctgtactaaaaagatgaaaaattagccaggtgtggtggtgcatgcctgtggtcccagctactcaggaggctgaggcatgagaattgcctgaacctaggaggtggaggttgcagtgagcacctgtacactgcactgcagcctgagggacagagcgagattctgtctctccaaaaaaaaaaaaaaaaaaaaaaaaaagaaagaagaggcatttgaacatttgaatggataaagaagaatgaaaattatctctatttacaaatgctctgataacatacctgaaaactccagggaatcaaagttaaaacaaatttaaacaataagataattcaatgatataacaggatgcaaaattaatgttaaaaaatatcattaggctgagtgcagtggtttgcgtctgtaattctagccctttgggagatgaaagtgggtggacagcttgagcccaggaattcaagaccagcctgggctacaaaaaagaaaaaggaaaggaaaaagaaaaagaaaaaaatgctgggtgtggtggcacacacctgtggtcccagctgtttgggaggctgaggtaaaaggattgcttgagcccaggctgggggatgaggttgcagtgagctgtgattgcaccactgtactccagcctgggcaacagagcaaggccctgtctcaaaaaaaaaataataataatagtaattagacaatatacacaaataataaacagagggcataatgatagtgaaaaactcatttactatagtaataaagaagatagttcaaaatacagttaacaagaaatatgcaaagcctatatgaggaaaaaatttaaacactccagaaagaaatgaagacatgaataaatggaaagacattccctgttcttggataggatgactcaacattataatgatgtcagttcttcctaagttaatatgtaaattcaatgtagttccaatgaaaatatatatgttgtggcatataaaagttgatactaaagctcatatgggaaaacagacatgcaagaatagctaggaaaagactgacaaaggaaaactacagaggaggggaactagctttaccagatgttaaaacatactataaagcctctgtaattaaaacagtgaagtactgatgcatgaatagacaagtagaccagtggaacagagtaagaagattagaattagacccacctacatatagcaatttaatatatgacaaagatagtatctggaatcagtgagataaaagctaacttcttaataaatggtgctgagacaactgggtagccatttggaaaaaagggaaaattggacacatatctcacaacaaacagtaataaacaccatatggattaatagtctaaatgtaaaaaataaaatcatgcaacaacaagaaggaaacctgaatgaatcctctgtaatcttggtgtagggaaaggctttttcttaatattactcagaatccaggggcagtagaagataaactgatacattttactacagaaaaataaattttgcataaccaaaacactataaacaaagtcaaaagacaactgacaaacttggagaaaatatttgtaacatacaacaaaaggctaatatccctaatatataaagaacttttaaaccttgagtgacaaagtctgggtgtggttgttcacactggtaatcatagcattttggaaagctgaggtgggagaatcacttgagctcaggagtttgagtccagcctgggcaacatagtgagaccctgtctctacaaaaagtcaaaaaattagccaggtgtggtggtgcatgcctatggtcccagctacgtaggaggctgaggcaggaggattgtttgagcccaggaggtcgaggctgcagtgagctgtattcatgccactgcactctagcctggcaaaagggaaaatgtgaaaaagagatgaacagtcaattttcaaaaaaagatataaaaatggctatcaaatataacttattagagaaattcaaattaaaactacatggagataccatttctcacctatcagattggcaaaattaaaaaaaaaaatcacattctgttggcgcaactgtgaggtaatgtgccctcttatacattggtggtaggaatgcaaattgctacaacccttttgaagggatatttggcaatatctaacaaaattacatatgtacttagctttcaacctagcaatcccacttctaggaatctaccctgaagctacacctccaacaatatgaaaatacatatcagaaggttattcattgcagtattgtttataattgcaaaatatataggagaatgattcactaagttatggtgcattcacatagtggaacactatgtactatgcagctgtacaaaaagaatgaaaaagatctctacaaactgatatggagtgattcccaggacatactgttatgtgaaaacataaaccccccaaaactatatgtagtatgctgtccctcctgtaagaaggaatggaggaataagaaaatacctctgtttatttgtggaaagaaaatgcaggaaggataaaccagaaactaaagagattggtcacctacagggggcacgtaggagaggggtggaagaaagtggggaatgggaacaggatagcaggggtcaggaggaagtgacactaacaaatgaatgtattattgttacaaatgaacctaatattgttacaaatgaataaaataactacatagaagggggtggggaagaaaagaacaaacctaagtagctgtggaaaagagtatattgactggattctataaggctaatgacagaaaggactgtacataaatgctgcaatctagttagaaatatgtttctcaaaggcgaatggcttagcaataaccttatgtacatactagaatgaacaaatgagtacatagattgcagataaggaaagctggatttctcactgttggagaaagaaattataaacaagggaaggttaaaacgaaccagaggtatcgttataaactgaggatttttaatatagataaatggatacagaaatataggcatgtgtatatgggtgggatagtacacatacataaacatctcctagttctgtccattgagcgagcacagcacagatgcagttactcctcagtaataatgagcatacctggtgcccagatcttcatctgtaaacattttcttttcttttcttttctttttttttttttttttttgagatggactcttgttctgtcacccaggctggagtgcagtggcgtgatcttggctcactgcaacctctgcctcctgggttcgagcaattctcctgcttcagcctcccaagtagctgggactacaggtacgtgccaccacgcccagataatttttgtatttttagtagagatggggtttcaccatgttggccaggctggtcttgaactcctgacctcaaatgatctgcccactttggcctcccaaagtgctgagattgcacgtgtgagccaccgtgcccggcctctcgttttttttgagacagggtctggctctgttgcccaggctagagtacagtggtgcgatctcggcttactccaacttccgcctcctgggctcaagccagcctcccacttcagccttccaagtagccggtaccataggtgtgcactaccacgcctggctaatttttgtatttcttgtagagactggatttcaccatgttgctctggctggtctcggactcctgggcttcagcagtccacccatcttggcctcccaaaatgctgggattacaggtgtgagccattgtgcctggccaacatagttctctaatgaaaggaaccagctctgctaaaagtggttgattacaggactgggtcagggcaaattcaggataagcctggaagtctagtggtgccagacaagacatgttgaaataatgcaagagccaacctgaaggaacacctactggctaaagctgaagcaatttgagtaagaaaataatgatagtattggattagaacccatagattaaaatctttacaaatccttattgatataaagatatatttatttcattaactaaccagaggggaagagaaagctcttccttccaatggaattccaattaataaatctgagagaaaagaaaaaaaaatagagaattactggccatgctcagtggttcatgcctataatcccagcactttgggaggctgaggcaggtggatggcttgagcccaggagttcgagaccagcctgggcaacatggcaaaaccccatctctacaaaaaatagaaaaattaaccaggtttggaggtgtgcccctatggtcccagctattcgggaggctgaggtgggaggattgattgatcccaggaggttgaggctgcagtgagccgtgatcatgccactgcacttcagcctgggcaacagagtgagactctgtctcaagaaaaaaaaaaaatacaaaacacaaaaatagagaattaccatcaggcagagatcacaatcataaatactgcacggacacaaatgcactgatagatgctaaaattagtaggtgaaagtctgaggagagagagcattgcatagtctcaaagtatctccccaggataccagcttactagagggaaaataataaatttataagaaaactcttcagacaccaagttaactgagtgattggggtaaatatcaccagtaataagatgtatggtatcataaattctttgatattatccattgagaaggatccaccatattttttgtggaattgccaaaaatgcataacttcattccaatcataaaacactggagaaacccaaagggaaggacgttctactaaataattgatcaggattcttcataagtgtcaaggtaatgaaaaagaaaagactgagaaactcttatagactagaggagaccaaagagaaataacaactaaatgtgaggtgggatcttggatgaaatcctacatagaaaaagcatattaataggagaattggtaaaatttaaataacatctacattttaattaacaatatttaattaacgttagtttcctgtttaagataacttataatatgtgagatgcccacattagttgacatagtgaggaatataagggaactctgtactatttttgcaacttttttgtaagtcttacattagttcaaaacagagtttttaaaagagctgtatacgatcatctcaataggtacaaagaaagcttttgataaaattcaacacctgttcattaggaatagaataaaattttccttaacttcataaagagtgtctttagaaaacccagaacaattatcatcctaattggaaaaatattagaagcattccttttaaaattcaggaatatgactaggatactactattactacttttcttcaacaccatattagagttattaaccagtgcaataaacatggaaaaatagatatgtaaagattggaaaggtagaaataaaactgccattattatagatggtttacataccttttccctctgaaaactacaaacaaattattagaaataatgtgaaaatttagcaaagtagctggatataagattaacatacaaaagtcaatcacatttctagagtagagcgactaacaataacaaaggaagctgccattgacaacaatattattttgtactaatagtaataaatgtagcaaagtatgtgcaagacctaaaaaaggaaaaatttttaaatgaagaaaaactaacaaagaatgaaataaacatatactttattcattaattggaagatttaacattgtgaagatttcagttcttttcaagttgatttgtaaattcagcgcatgttcaataaaaatcctcgtaagatttcaagggcgcagtggctcatgcctgtaatgccagcactttgggaggccaaggtaggaggatctcttgaggcaatgagttaaagaccaataagattttcatgtaatttgataagattgtatgatatttatgtagaagagtaagtggttgaaaacagcagggcattttaagaagaaaagcagggaagaataatttaccctatcagctatcaagacttagtatgaacctatagtaactgagatggtgtggttttgcccagttgaagtcagttaaattttaattttgagatttctgtaaaagatacaagtttagtcttttattatgtatatttgaaggtgttacattttggaaagtgtgtgtgtatgaatgatagctaaatggcttctaagtaaaattcagcatatcttgtagatgttgatagaatagaaggggaaggaatgttttgaaataatgaaaataacatggtatgcaaatgctttgcaagagatttgggaaatgtagatatctctggttttaaggatgatctagattcaagtaatagttcagtaatttcataaaactcttatgacaaaattctggatggagaatattctatgaatcccctagagagtttcaggtttttgtagaatgatgtgaaaaatcttgaactaattagataatctttagaagttacttcacaatctttgtttttacacatacacaggaatttatggtgctttattttttacaggttagtagctaaataaagtatattctaaagtttttttattgatgtagggaaatggctaccagtggacattttgagaatattgcagttgtttttcttctgaaagagtaaaccgggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcacgagctagcgagcgagaggcagccgcgcccgccgccgcccctgctctgtatgccgctctctcccggcgcggccgccgccgatcacagcagcaggagccgccgccgccgcggttgatgtggttgggccggggctgaggaggccgccaagatgccgcagtcaaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatctttaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttggaaataagaaagacctgcatatggaaagggtgatcagttatgaagaagggaaagctttggcagaatcttggaatgcagcttttttggaatcttctgctaaagaaaatcagactgctgttgatgtttttcgaaggatgattttggaggcagaaaaaatggacggggcagcttcacaaggcaagtcttcatgctcggtgatgtgattctgctgcaaagcccgaggacactgggaatatattctagctgaagaagcaaactgcccgttctccttggagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttattggcattaatttttcagtgtagtttgttgtttaaaataatgtaatcatcaaaatgatgcatattgttacactactattaactaggcttcaatatatcagtgtttatttcattgtgttaaatgtatacttgcaaataaaatagctgcaaacctcaaaaaaacaaaaaaacaaaacaaaaaaaaagagtaaaccaatttggttactcattttaccaatttggttttgattttgcaagtggttacaactcatgagaggattcttatttctgatcaatatattgtgtttttggaaaggacttctgggaaataattatgatgaagccctcgagcaattgcaacaaaaccaaaaattgaaaagtgggacctaataatacttttttaaaatttattttttagagacaggatctcactgttacccaggctggagtgcagtggtctgatcatagctcactgcagcctcaatctcccaggctcaagagattcttctacctcagcctcctgaatagctgggactacaggtgcatgcccccatgcccagctaatttttgtattttttgtagagaccaggttgtgtcatgttgcccaagctggccttgaattcctgagctcaagcgatcctcttgtcttagcctcccaaagtgctggaattacatgtgtgagccaccactcccagccccagaacaactattattaaaaagtcaaaaaacgacagatgttggtaggctgtgtagaaaaggaaatgcttgtacactgttggtgggaatgtaaattagttcagccgctgttgaaaacagtttggggttttctcaaagaagttaaaactgaactatgatttgacccagcaattccattactaggtatatatccaaaagaaaacaaattgttctaccaaaaagacataagcacttgaatattcattgtagcactattcacagtagcaaagtcatgcaatcaacctaggtggccatcagtggaggattgaataaagaaaatgtggtacatatacaccatggaattctacgcagccataaaaaggaatgaaatcaggatggtgcggtggctcatgcctgtaattcccacactttgacaggctgaggcaggcagattgcttgagtccaggagtttgagaccagcctgggcaaggtggcaaaaccctgtctctacaaaaaatacaaaaaaattagctaggtgtggtggtgcacacctgtggccccagctatttgggaggctgaagtgggaggatcacctgagcccaggaggtggagtttacagtgagctgagattgtgccactgcattccagcctgggcaacagagtgacaccttgtctcaaaaaaataaataaataaataaataaattgcagcaacacagatgcagttggaagcaattatcctaagtgaattgagggaggaacaggaaaccaaataacgtgtattctcacttataagtgggagctaaacactggctactcatggacatagaggtggcaacaatacacactggggactactagagggagagggttgaaaaactacctgttgggtactgtgctcagtacctgggtgacaggatcacttgtaccccaaagttcagtatcacgcagtattcccaggtaacagacctgcacatgtacacccgaatctaaagtaaaagttgaaaagaaaagacttctgtactttcatctttatagtgaggtgttacatgttttacaaacctagttctgataatgtgacaggaatataaatttatcttgaatattattaaatatataagtcaaagatcaacacagtgtttccatgaggtagactttttttggaatctaaataaccatgtgtttccacgtaaatttttatgaatcagggacaaatatataatttgatgtcagagatgtttttgttccccaaaagctctatcttgttcatgaaaaacgaagcccagagaagttatgtacaagttcacagagctcattattgacaaaaccagaatttgaatacaactcttctgattccagatttgctggaaatactgtgaaagaagaattcagtctggtagtattacgtgtggttttaattttttctttgtaactttagtttgaattttatgtgtgtgtgagcatctgcatttacttttaaaaacttttattgtaaaagccttcaaacatatacaaaagtagagaatacaaagcataatgaacttaagtacctattagccagcttattaaaacatggtcagtcttgtttcacctgttacatcccttttcttttactgtctaaaggaaggaaagaagaatcacaaatcagtttatgaagtctgctttctaaaaagtacttaagtgtttattgccaatatcttattttggtcggcaatcaatcacatactcaagcatacttctcttaccttcagagaaattaaaatttaatcagcaaaactcatcagcctgtacatttaaaatatatgcatgttattgtacagaaactataccttaataaaaagtgagaaaaaaaatgagacaggaaagagaaaaacatttaaaagacatagtaactgaagaattaaataaccaatccaacacttgaaaaatattacaatgtagcacatgcttaaaagctctctgagctcagggaaaaaagcagcactgtgaatctatagtggtcatcattctatgtggtattgggtaggacaagaagacagccttgcagctggaaattggtgaggacggaggcctcgtgtggaaagagtaaggcacactcagggagagaaccagtgaggtggctctgagcctgtttcagaaggggcttgaggaagaacggcagaggctaggatagttgggaaagcaggatcaaatcagactccagggattggggaaccaattggctgttacagggtggtggagtcaaaaaagaacagaaattttgtgtttggttaattgatagaaaatgatattattaacaaagtaaagaagtatgggaacagcacaagttttttggggatagtaaataattccatttccattgattaaaaatatcaagtttatttttacatctaaactgattcaagacttagctattgtacatgttttagagaaaacaaaactatattttatatctaatcatactttacaacataaaatacagttctaaaaaatattatttgtcaagaaaaatataatgttgccatcttttgtctgtatgcatgttttttttccttagattccagcgtagttagtgacgttgtacttcaagacttactggcatatgtgtcctcaaaacattcctacctcagagatcttcctccgagacagcctcagagggtgaacagtatagactttgtagaattggagcaccttcaacctgatgtgttagtccacgcagtactaagagttgttgatttcctatactgacaggtaaacattttgactgcctccttaattttagattatgaaaaaattaagatacaagaccatcttagtgtaccatttggttatcactatatatgtatcatcagctattaaagtatggtatcatgtgtgatagagtaatgccaactaagatactcattttccttttccagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggtaaatacaccaaaaagcatttaacctatttatatttcggtaaatgattaatgtttatgagcccaagatggagaaaatcttaagagacgagacagcatttgaaatacaagtgatcatgattgaatattcttctgcaaatttcttctgttaaaattttgtacctcttgtagcaattcatttatctaataagtcttcattaattaatggtggtgaaataaaggcttaaatttattcccagatatactactttacctttttagtgaagatcttacctccttcaaataatgttctttaaacatttaattctggagaagcttctacaattttttttcagccagagtactctgataaataaatgctatgattataaggcagatgtcaagggagttaccttaactctttcaagtcacaattaatgttcaataaattacagtttcatatttttattatagttgttttaaaagcatgcactgttagccatccctagaatgttcagtgttaaaatatgacccatgattacatttttctttaaagcataaattatttctggtatattgaattaaatggaattgatgtttcattaaaatagtatagtgtcttccctttgctattgtgagatcctttagttgtaacaatcaaagacagtttcatttgtggcttatgagttatttttccctgctaaattaatttagagattgattcagtatattattattttttacctgaaagagttaatgtctctccaaacttctgccttccaaatagttatttgtagataggatctatcacattgtctctcttaatcattaatagctatgactaggatttgagataagtctaactttggacttttatgttaagatcaaacagggacagatgtttgtttggttgagcaagctgacaaacatgtatcagtgatagactaactatgatcattgaccaccatagcctggctgagaacatgagtctagtgcatgctacacaagaatgtaggtcacaggtatagtggagctgtaacagagcagattgctccatgtttaatgtgaatattcttttaaaattaatagttttttggttaatagaagagaaattacagttgtctctaggtgactctatggtgtttaggttagtattgaaaacgtatgaatccaggaattaagatgttgttgttctttgtacattcattcatccagccccccttatttgtaaccatcattttaaagttttaacatctacttcaatacctcacatcagtctttttaagataaaaataccaattttgaaggattacttaagtaattctattttcctgattttacttttcttttcaagagaccaaccccatttccaaattcccagcaaagagaatctgattgcccagagtaaatttgattcaaaaaactgtgatcaggaagacagggtcacgcaatacaaatatgagagcttgagcttatttcagtggatgggaaaacagttaagggaatcatttgtgatctgggtgaatacataaagatattcactaccaaaaatgtgtatgttcattagcttagaaagatatatgtaatgtattatttagtttaaaaagtagattataggccaggtgtggtggctcactcctgttaacccagtaccttgggaggctgaggtgggtggattgcttgagcccaggagtccaagttctcatcttaaaaaaaaataaaaaataaaaaaaattggattgtaaaacttcatgtatagaaaatatattatgttatcatataataaatatttttatgtttatataagttaatacacaaaaattttcaagaaaaccctttatatatgatagtatctcattttaataaaaatgtatctataagtacatatgtgcatttgaaaacctggaaatatgcatgtatagcaaaatgctagccgtagttatttctgtatagtagtattatatgtgctttaatttttttctttatacctttagtttgaatttcatatgtgtgtgagcatctgcatttacttttaaaaacttttattataaaagccttcaagcatatacaaaagtagagagaatactaagcataaggcactttttttttttgtttgtttgagacagagtttcattcttgtcacccaggctggaatgtagtggcatgatctctgctcactgcaacctccacctcctgggttcaagttattctcctgcctcagcctcccaagtaactggaattacaggcatgtgccatcatgcccagcttatttttgtatttttagtagagacgaggtttcaccatgttggccaggctggtctcaaactcctgatctcaggtgattcacccgcctcagcctcccaaagtgctgggattataggcatgagccagccaccgcacccggccagcataatgaacttcggtacctattagccagcttattaaaacatggtcagtcttgtttcacctgttacctccctcatctttactgtttaaatatttcacaataaatgtattttattttataattaaaaataaaattaaaaccttatgctttttaaaataaaagaatagttaatgtttggaaaatctagctaacaatgtgagaaaaaatagaattaaatttatactttatatttgtgccaatataaatttcagatacattagagattcaaatacaaaaataatgaaacaatgaatagtagaagaaaatataggcaaaattatttgtaatgcaaaggttggtagggtaaataaaatccaggaacaaaaactattatacataaaaaccaccatgtacaaaattgaaaggcaacaaaaaaaaaacagaaaaaaaattacattgtcagacaataatgcagtaagcaaaagacacatatctatagagttaaatggggaaaggatatgagtaggcaagtccccaaagaagaaataaaaatggccaataaatatatggaaaaattgttcttacaagtaattgaaaacacacaaagtaatgatgatagattatttttcttttaagaaattgattgagaagatatgggaaaacagctactgtcatcagctattggaaatgcaaactggcagaacctttcttgaggataactgacaattaatatgaacaaattgggggtacttttagcccaataattttagctctaggaacttatcataactatgtataaagatgtagctgaaaatgggtttatcatggtatcatgtataattgtgaaaaataaaaaacaaccagagtccctcaaaatagaggtttgctgtaataatttttaagattttggtgtatctggacaatggcatattatgtaatatttaaaagcaatgtagaataatacatacatataaaactatatttgacttattaagtcaatcccaataaataaaatcccaaacaactggttgtccgctaaaatgttaactgcttatttagggtgttgagattatggctgctatatgtttatttacttggcttctcttagcttacttttctaatcaggtattttgtaataagacaagaaagctattttagtgattggttttaagcagtaacttggaatatatgctttagttctagctagtgatgttctgtctttacagatttactgagatgtttgatgattttccaccaaaaaaaaaaaaaaaatctttagtgaaagaaactaaggagatgagcaggtgtagtaaattagatttatggcctgaagtgagaaactaaaaagacagctgatgttatcagaaaaatgagtgctaagaaaccctcttttgttttattatagttttgaagttgaatttactaatacagaatatgataatacagataagttgaatttactaatagagaatataacagtaacaaggtctgtgttactgtggctttaagtattagaattgtggccggcgcggtggctcccgcctgtaatcccagcactttgggaagccgaggcgggcggatcacgaggtcaggagatggagaccatcctggctaacacagtgaaaccccgtctctactaaaaatgcaaaaaaaattagccgggcgtggtggcaggcgcctgtagtcccagctactccggaggctgaggcaggagaatggcttgaacccgggacgtggagcttgcagtgagccgagattgcgccactgtgctccagcctgggcaacagagcgagactccgtctcaaaaaaaaaaaaaaattgttactgagagttaaaaataagtactattgtgtctaaatgctttttgttctagaaaagttaactaagataactaaagtattgaaatatgagtgaaatattagacttgggttcatttcagtgtcctttctttaacaaaacaaaacaaaactttgcctatagatagatacatgagaattttctttacagaaagcagttggttattataaatgatgaccgttcaggagggcaaggaatctttagaaaatattttattaaaattatctctggtggcccggcgcggaggcttatgcctgtaatcccagcactgtgggaggccgaggtgggcggatcatgaggtcaggagttcaagaccagcctgaccaacatggcgaaaccctgtctctactaaaaatacaaaaattagccgggagtggtggcacgcacctgtaatcccagctactcaggaggccgaggcaggagaatcacttgaacctgggaggtggaggtttcagtgagccgagatcacaccactgctctccagcctgggcaacagagcgagactctgtcttggaaaaaaaaaataataataataatctctagcatgcttctgttgtcttaatgcaccattcatattttgtctctgtttacccaaattctttagtgataaaagattagtattcaactgacttaatcagatcaatctatttaatctgatactaagcctagatttttttttcctttttggtgacttttgtttttactgtttttgtttaaggttatatttgggaatttaaatatctttttgttcagcgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggtaagatttttatatacataaattctgctatttttatttcttttgaaacagagtcttgctctgttgctcaggctggaatacagtggtgtgaacacagctcactgcagtctccacctcccaggtttaagtgattctccccgctcagcctttcgggtagctgaggagggaagggaaggctagtgcataccatcagtgcatgccaccacacccagctatttatttatttattattttggcagagacagagtctccctatgttgcccagtctggtctcaaactcctggactcaagtgatcctcttgccttggactcccaaagtgctggaattacaggcatgagccaccacacccagcccactgctagttttaatataagcaaaaaggctaccacttgtggtaaaaatgtataagtctatataaaagtgaaatataaatctttgcaaatatctgaactagattccagtagttttaggaactatgtgctaggaaccagggacaaagagcaaatacctattttttattatatgacaagtgggagcagaaattcagatccttactttatcttggccaaatgccagattaaaatgttactagttgggttaattcacatatatgtgtaaatatgttttccaatatatgattgaaggttagcattgttatatcataaaactatgctaaggagaatacaggcagaaaacaaagacaatacctctcaaaaaacccaacttttaattgaatacagagatttcattctcagagaagaactccttattcttagttctacactgaaacatttactaataccagcagatagtttaaattaataatatttctggaaggtaaacacagatgatagaaaatttataagcttttatactataaaaatttcatactattttcaaaaatggaagttgcctatggtcataaaagactctagatttatactaactggtaaaatcttggtaatgttatagcatcatgtaagttcctaagccagttttatatttatgtgcccctcccgtgctctgcttctccaacttcacagacatatagaggtggtcaccacaggaaggaatgccagacacagttgaggggctaccttactttgcagagacgtttagtttggtgccatggagaagtcaactctgttatttactgcttacacaaaacagttatctgctgggattgaagtctagaattaggtttaaaaataaaaataaataacatcatggacaacaacaaaataggaggccaccacgctgatgatgaaagattctcaggctatagccccacttgtttgaggacgcagccaggaattgtgcatgttcttggaagtcctggaggtgtgctcctcattagcaagccatgccaaaactgtgccattaaaatcagtccttcagaggctttgttcacagaggcctgtttagcctttttcattctctttatgttcagctatgagggctgaattcatagtttctgtcatagtgtatgtgtttttaagacaaaaatggagagagaatatgaaaacacaagcaacttttccctaacctattttatagttaaataaaaggagaaagagagatcagcatgggagcatttcctagaagggtctgcttgctcaacaaaagccagagggggatgaggctaggcctgagtccttgtaaagaaatgaagacgcttacccagtacctcatcttaccgccagcagaatttcagtgctcagccggagtgacccccttgaaagcaaagtccacattcagcgtgaccttttaattcttttcaagagttgtgtaaatttacaaaatgataggattatgtgaacattcttttaaaattattgaattattacgaattttttaggctgggcagggtggctcatgcctataattccagcactttgggaggccgaggtgggtggatcatttgaggtcaggagtttgagaccagcctggccaacgtggtgaaaccctgcctctactaaaaatacaaaacttagccaggcatgatgtcgggtgcctgtagtcccagctacttgggaggctgaggcaggaaaattgcttgaacgcaggaggcagaggttgcagtgagccgagattgcaccactgcagtgcagactgggtgacagagcaatactctgtctcaaaaaaaaaaaaaaaaaaaagactttttgagtggagggaggagagcaagggttgaaaaactaactgttgggtactctgcctactacaggagactacttgggtgatgatatgcccatgtaacaaacctgcacatctaccctctgaatctaaaataaaaatcgaaattttttttttacatatttttttaggccagacacattggctcaagcctgtaatcccagcattctgggaggccaagaagagtggatcacttgagcccaggagttggagaccagcctggtcaacatggcaaatccccatctccacaaaaaaatacaaaaattagccaggtgtggtggtgtgtgcctgtagtcccagctactcaggaagctgaggtgggaggatcacttgtgcccagggaggttgagactgcagtgagtcaagattgcaccactgcactctagcctggacgacagagtgagactgtctcaaaacaacaaaaaataataattttgtagtgatttaacatgtctttggaaagatgtggtattgaatcttctacagtttgttacatattcgatcgctacgcactcctgctaactcatgtagggatatgtgacacaattggaagagatgatgaaaccgtctttgggcattgaaagactaaagcaaatgaagttaagaacagaagactcatcattaactggactctgaaagagataaccagaaaacagtaggagactagagtgattagttcttgacctggagtgttcttacttctaagtggatgaagaagaacaaatttgaaggcttaaggcttaaagaagcctttaaattgactatggagaaagggagaataatgctcaagaaaactcatagacctcaccagtacacagtaagacaaaagtaaattaggaaaaaataatgtctgggagatagtagactttcagtatttgtttactggtgaatggatgagccattagcagtgaattatgaatatgcttgaggtttcttgtgagtcacctgagaaacgattaataaatgagaactttttataacccacagccagagtatatagatgataatggtgagcggaaagttggaaaaaagtttaaaagagaacaggctattgatatttttacgtagagagaagaagaaaagttcacctcctatttggcttttttttttttttttttttgagacggagtctcgctctttcgcccaggccggtgtgcagtggtgtgatcttggctcactataagctctgcctcctgggttcaagccattctcctgcctcagcctcccgagtagctgagactacaggcgccagccaccgcgcccggctaattttttgtatttttagtagagacagggtttcaccatgttagccaggatggtctcgatctcctgacctcgtgatctgcccgcgtcggcctcccaaagtgctgggattacaggtgtgagccactgtgcccggcccctatctggcttttcaccatgatcagtttaaaagaagacagggcaaggagagagggcatgttagctagtttcaagtattcgaagggatttcttctaaaggaggtattgaacttattttgcctgattccagaggatggggaaggaaggaaacatcacatgttcagccaaattagccaagtaaacctgctctcagttgcagccagacctccctgcccttagattctaggaaaatagtaaagaagacgaagaacaagacctcagtgtatccttttactacaagtgactgtaaatcaactataaaattagccatgtttgtaaattaaagttataattttggcccaataatttataacatatctgtttgttgtttgtaggagtggttctaattaaagcccagatttcagagctggcatttcctcttacagcagctcagaagatagctctaaatgctcacagttctctgaagagtattttttcttctcttcccaacatcatatatactggctgtgcaaaatgtggattggaactagaaacagatgagaacaggatctacaaacaatgttttagctgcttgccatttactatgaagaaaatatattataggtaaggcaactaagcaagccaatttgatggaaaataattattatagatctggaaaaactagtctgtaaactcttactttctaaaaagaattaactagagctagtcgaagagaacaaaattttccctgagtgatagatagctatttatggtagcaaaaattacccaggaatcgttataggaatttcttaaagataggaatttcttaaagcagtaattgggagattttattgtcttcaaacagctgtaccaaagaaacattttccttggtttactttttaaccaaaatctaaatgctcataaataactcattttcccaccttaacatataattagaatttaaaggctaaaagtaccatatgatgtcacctctgagttgttgtggaagctagtaagacatttaagctgttttcccacctttaccttagaaattaaagctagcaaataaatgttatatggtaaaactgctaatcagctcagtgaaaaacacattgttttttgaataataggtagtcaaaagctcagacatttttctctttaccttataaattacatgtgtttacaaaatagcactcagtgttttatgctccttatgattatttctaaatattgcggtatctaaaaactaaattcagatatattccacatgttatcatggcatacttcaagaaaagttatagaagcttaatttgtaaaccttatttctctttacagatattatgtttgttataaataagtgaatgaattttgctattactgtgaaagttgcttttgtggaaaagaagattgaattaagatgtatggtaggctgggtgtggtggctcatgcctgtaatcccagcactttgggaggctgtggtggggggatcgctggagcccaggggttcaagaccagcctgggaaacacagggaaaccccatctctaccaaaaaaaaaaaaaaaaagctgggcatggtgacataggcctgtagtcccagctacttgggaggctgaggcgggaggattgtttgagcccaggagatcgattgttacagtgagctatgtttgcaccactgcactctagcttgtgcaacagagtgagaccctgtctcaaaatcaaaacaaaaaatgcatggtatgtaacaaacaacattgatttattaatagttaaggcccctcaaaagtatgtataggtgacttatttatatcattccaaatgtttctattcaacataagcatttattggacaaaaatgttgctcaatactattccttatggggaggagggcctttgaatctttagtttacaaaatgactgttcaagagaaggacttcacagatcagtatcacctgattatggcataactagtatggggtatttaagatctcttcctaaactataccacattaaagatgtagtgctagtttgttgtcttactagaatgttgaatggtcatgttaaggcaagaattattattttttatttatttaaaagcctttttttttatttttttgagacagagtttcgctcttgttgcccaggctggagtgcactggtgcgatctcagctcatcgcaacctctgcctcccaggttcaagtgattcttctgtctcagcctcccaagtagctgggattacaggcatgtgccaccacgcctggctaattttgtatttttatagagacagggtttctccatgttggtcaggctggtctcgaactcctgacctcaggtgatccacccgtctcagcctcccaaagtgctggaattacaggtgtgagccaccaagcccagcctaaaagcctttaaattattagagtccagattatgtggtttccttggaaagaaaatattgaaattaacaaactcccttcaagttatcaagtatgtgactccaaaatcatctacataaatcaatcagcaaactgaataagagaaaactctcattgattatttttctaagactcagtcaaatatttattaggaatccacgtatgttcacatatcacatgtgtactgtggatgttatactagttgatctaagtagacttattgtgcccaagaagcttggtagtccatttaagaaacacttaatgaacatttgtgtggcacaacagtcccaaactatgagtgggttgatcatattttacattggttgtaacttggagctgattttccaatggaagcaacattagatattgcaatggagtctcatacgaggccacagacatttattaaattaacatgtagatagcatagttcctgctcttcaagctatcataaaactcaaataccatttttaacaatgtttctacagaatattcagatttacatttttggaatacaagaaatacatttatttttctgtactggaagcaaaaaaccccagcaggtcaaaccacaattaaggctcctatttaggcagcactaggaaatgtttgggtctctcaagaggttgtagtcaaggtgtaggctggggctgcagtcatctgaaggcttgactggggctggaggattcatttccaaagtggctcattcatatggctggcaagttgagttcctcttcacttgggtgtctccacgggctgcctgaatgttctcacaaagtggcagctcatttcctcagagcaggaaaggcaagaaagagagttccaggtggaagccagcctttttgtgacctagactcagaagtcatgtggcatcacttctaccaaattctgttcatcagaagtgagtttagctgtgcgttggagagtggattagaatgaagctagtgcagagaagcggtaagaggctgttgccttattttggagaggagatgatggtggcttgactagagaggaagcggtaggaataaaaagaagtggacagatttgagaatggtcagaaaatagtttgcaagatgtagtgattggtaggtaaagagagagcacaggtacattgcaaatcattgacagttgggtgaacaataagattatttattaaaacaagtaaccttgggagaaatcttgatcatattgagcttgagttcctgagaggtaacaagttggaaagtggttagatgtaaagaaatgcaatttgcaagagaagtctgggctaggcttataaggttatctgtggtgattgaacttttccttggtttctgcaccctgttttgtttttccttcttaatcttcagtgattacctctcataatggattattcttactagcctataaagacagtcccatatttctcttattaaaaaacaaacaaaatcatccattaacattacatctccctcttatcccttcgtttttctattctgttttatacccagccaaactttgttaaagagttgtaaatatactctctctcccctattatgtcttcagtttcacttcagttattccattctactcctaccatgctgcagaagctgcttttgtcaaagttacacttttgatgttgcctgaggcatggatacttctttcctcgctctaactgctctcagttatattcagcatgtcagtccacttcctccttcttgaaacagcctcctccttgctttctaacctgtctctcaggcccttctttctcagccttttctaccccctctttaaatgctctcgtctgtgtccttcctcttattctttctgtacattctgcctggatgatcacagctgttttcgtatttgtacttaacatcttcaccctgattttctcctccaggctccagtagtcaggtatcaaattctttgcttgatgtccatctcacatttaaacatacccacaatagactcttgtttttcctaaaaccacactcaaatctagttctcttcgtttttatactttctggaaaatggcacaccatctacccaattatttaggctggaaacctgggcacaatcgttgcatcattttctcttccctacctcccctatctaatctattagcaagtcctaggaattttcattcagaactatatcacaaattcatccacttttttccatctccactgctaacatcttagtccagtgtatcccagcaggggcattgttgacatttttctcaggacagtttctcattatgtaccatatcccacatgctgcggggcatgtggcatccctgtttaccttcccctagctgaacctcaattactgtgaaaccaaaatggaaagtcagtgcctgctggtctggaatcactcaggcctcatctgagtccctactacctgttgcgcaaaccagcacaccagcagtctcttggtggggctcctcctggccttgcctcctcccctttattctccacccgttggcagtgtgattaccctttgcttcacccatcagtcatctccttatgcttgtttcctctgcagtctcatctgctgccactcccctgttgtccagcactctagccacgtggccttctttcagttcttcagacattttgatttttctccttaggatgttctcgaatgtcttccctctgactccacaaggctggtttcttcatgtcttagattaaatgctgctttatcagagaggcctctcctaaccacccttctttattttctgttatagtagcctgggtgtgcttactgtaatttgtatttgcatactgtcttttctaaaaaacatttttactgaagttaaaattcatataccatcaaattaatcttctgaaatgtacaattcaatggcggtagtatattccaagggctgtgtagctatcaccacaaccagttaggacattttcattacccagccctttacaaagcctcatactcattagcagtcactctccattccccatgcccctcaacccatggcaactacgaatctgctttctgtctctatagatttgcctgttctagatattttatataaatattatataatatgtgatcttttgtgactggcttcacttagcatgatgttttcaaggtccatccatgttgtagcatgtatcactacttcattcctttttattgcaaaataatattttattgtatgcacataccacattttatttatccattcatcagttgatggacaattgggttgtttctactctttggctattatgaatgatgctgctgtgaacatttgtgtacaagtttttgtgtggatatgtgtgttcatttctcttgggtatatatctaggagtggtggaattgctgggtcatatggtaactgtctgtttaaccttttgaggaactaccaggctgttttccaaaattgctgcacaattttacattctcatcagcaatatgagggttgtaatttccccatattcttgccagtacttcttattccgtttttctttttgttgcatgtgctttcgggtcatatctaagaaaggtgtcatttctaagccaaggttatggagatttgctcccgtattttcttctaagagtttagtagttttacctcctacatttaggtttattatctactttgagttaagttttgtatatgggataaggaaggggtataattttattttttggcatgtggatatctagttgtcccagcgtgaatttttgaaaagactgttccatccctgtttagtcatcttggcaccactgttgaaaagcttattttctttcttcttctttttgtagagatgaggtctcgttgtgttgcccaggctggtctcaaactcctggcctcaagcagtcctcctcaccttggcatcccaaagcgctgggattacaggcatgagccaccgcgcatgcccaatttcttcctatccctctacagttttacgttccttgagtgacggaaccagatttgtctttttcactagtgggtacccagcacttaccacagtccatgatagatactcagtttgtatttgttgaaataaataatggagggagagagaggctgaggaaagagtgtagagtgaaaagaggaaggaacatagagtcatcgtgtgaataaagggggaagtgggtttttagggggaaaatcagtagttatgttttagctctgttacattaaattcccccgctaatgagcctgtttctgaattctgttctcaatttattttttaaaaatcaatgtagttataaaataggtaccacatgccatggttaaaatgcacactacataggaggttataaaacaaagagtgaaagtctccttcaccatccaaccctctcccaccagtgctgcttccatgctggtgagaaggttttttgtatgtccttccagtgatttattatgttcatcccagcacatgtgtatccctttctttagaagcatgtggacagaagaatattgttcatattgttgttccctagagtctatcctggtgctccttccctaatagcacttgcaaatgttcttcattctttttatcagctacatagcattaagatgtaggatgcactgaaaattgttaatccagttttattgatatgcaaaacagtttatttctgataggaaagaattcagttgaaaaaagtaacttgaaattgtgattgtgaaatatgtgattattatttttattttcatttctaaaaacaatttataaaacagtttaatatatttttatattagtatctgaaatttaaaaatggatatagaataaataaaatgtagtaatttatcatttgaagctcttggggaaaaaaaaacctttttttccttctaggatgtcacagaacatcctagagttgttttaagcattaaaattaatcctgcattaaaaaccaagtgctttttggaattatttttcatttaaacatttcttttatttgaaaatctttttgaaggtcgtgtgttgtttactcttctgtaggccagcgttaatgactgccgttgatggaagacataatgtttacatccgtgtagaatcaaaactgatagagaagattcttctcaacatttctgcacactgcctcaacagagtgataggcaatatatcagtgtgccatcaagaagttgttttattcaggagtataaatggtatatcggaacagaaagagcactctactttaaattaagagcttttctgtccatatgaaaacagaaggataatttagcttaagtgaaatataagcctatgtaagttagaaggttgacttgctttacacctgttagtacatgaacagtgggaggcacctaatttcttcttaacctacatttcctgttggtaagcaaaaactattttacttaactctagttttataagaatgaagtcaatgagtgtatgacataatatatatgaagatagtccagtgtcagtggaatggatttgcaagatcttcaaccatgatgtcttagttgtcagtggctaagaataaagcaaagataatatatttgtcaggtattcaaactccattcctgttctcattagcctcagatcctctaagctgatgagctaatctggttctgtgattgctttatctttcaatagtagattgtttttcgtgtttttttttagttgggggtgtctagtaattttgggttgaatgctgaacgttgcatatattaagtagaacagtacaaactgaggtaaatagtagttgtacctggaaacaggcatgcctcttctggtcctttactggaggtgaggggtgagcaggatggtcagccttgtcataagttgagttggattcaggttttgttgtttctctggttaccttcaggtcaccactggtttcaaattatcttgtgcttatggtgggaagtggttccccagtattcctgctccaccatcagcatagccctccactctgcacctgggcctcagagaaagtttctttccatattcttgcacctccccaagttgcacaagcttttgttggttgttatttggtgcatcctaacctggtgggtgggagcagggttgttcctctttgattctggtccagccccagtcttatacggatgttgcacatggcgctttcttggtagccctgtcccttatgtggcatggcagctgagctctgtcttgtgcctttagtgggtcttgtgtggtcctggccctgccccagcagtaggggaccactaatggtcttgacccagggtggtttttcagtcctcccccaggatggaggtttttttttttcttttttctttcccccatctgtactggttcctcacctgtaccctggggcaacaggatttggtgtccctcctccagcaattgaaggcttttgttccttaaaggggaggccagatggtgctttgtgttttgtagttggaagctttctctgatgtcttgccctgcccccagtcttatgagcacctggtggaggtgagacgtactatgtggaagagcctatgaggatgcagatgttccttatgttgctgacactggcagttcattggctttttgcaattaatttattaataaaaattaatcacattcttctttcctgcctgtatggaggacctgtcttcttcccaaggcctgccccaagggaacctgtgctcctgttccatctccctggaggcacctgtctccttatgtttcagtctttttggctgttttacaaccttggttctcatgtgtattcaagaaaatgatgattttatatttattcagttttttccagtaactgttagggtaggagccactttttccagctttctacatcttaattagaagcctctctccgttttttcccccattttctttatttcatttttattcttttggctattttcattccttttcttaatgttacttatatattttcagtgttatctcttctttttttttttgagatggagttttgctcttgttgcctagactggagtgctgtggcgcgatctcagttcaccataacctctgcctcctggattcaagcaagtctcctgcctcagtttcccaagtagctgggattacaggcttgtgccaccatgcccggctaattttgtatttttagtagatatggggtttctctatgttagtcaggctggtcttgaactcccaacctcaggtgatctgcctgcctcggtctcccaaagtgctgggattacaggcgtgagctgccgtgtccggcctatctcttcttttttgcataatgtaaattagtctttatctcttagagaagcataattctcatatcacatatacttcagtgttttgtccattcttgagacaattaaagttgtacttcttggcattaattagattgtgatcataagtcaaaatgtcattggtcataaagtggtcatcagaccatgcagactattactaatattggttatgttttagtttattgcagtgaaaatacaaaatttaaaagttattgtagagaattatcataccccccaaaatatgtcattggtcctccaggactctgtagtccccatccaagaaagactgtgataattgtcaaggggttagtacggtctgagcatggtcgatggtgctctgtcattctggtattgaacaacctcccaaatgtcttgattacatgtcctaaaaaagtgaggggaagagtgtaggacaaatgcaaaataaaataacacatttagctatacttttagtattttttattattgagattcaatatttaagtgaccgattcaagattcttttatataaaaaatgaatatatgcataagtaactgtgataagaactgtggatggataagagcactcgtctgatgtactgcagcataaccagaactgctgtcggtctgaacggtgtgttatctgggcctgtttcttgtgtcagggggatcacatgccgtcactctggagtgcctcaatagcttgtaactagaaagagaaggtatagaaagagtagtttacttacctgtttatttatttagaggcagagtcttgctctgttgcccaggctggagtgcagtggcacaatctcagctcattgcaacctctacctcctgggttcaagcaaatctcctgcctcagcttcccgagtagctgggattacaggcatgtgccaccactcccggctaatttttgtatttttagtagagacagggttttactgtgttggccaggcatgtctcgaactcctgacctcaagtaatccagccacctccgtctcccagagtgctgggattacaggtgtgagccaccgctactggccgggaggagaaatttaaaatgggtttgagacttgaggaaccaaaagaaacaatgaaaccattcaatgtgtgtgctcctgtcaagctagcagcgatcttgagagctctgtgttttcgtcttctgcagttccttcctcagagatcacctatgggatggttgtggcagacctgttccactccttgttggcagtcagcgcagaaccttgtgtattgaagattcagagcctttttgtgttagatgaaaacagctatccattacaacaagatttctccctcctggatttttatcctgacatggtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagataaattaaaacttttttctaagaaaatcctgtgaggtttaaaaagattgtttttgtcttttggtttcttcctttcttctggagaaatgatctaccagtcaaggcaatatgtagcagatccctgggaattaaaggtttgcccatttgttcactgtatttagtccctgctacattccaggcatcgtactaagtatggggaaccacagagaagacactccttcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaagtgaaggaaatgagatcatgtttcaatttattaaagcagggaagagcgttctgtggttagttcgtgtctaggatttgagtgccttactgaatgtatttaccagcaaacatgtagcaatctgttctctcattgtgattgtggaagaagctcatgtaaaatgatagtcattaatgaggaagtatggcgtggtacttattctgtaagctcagagtatgctgagtgttaatagattgtcatattgcctgaaaataaattcatgatgacatgaacaagcttcttttaccctgtgtatgtttttaaaaattcctttggttcagaggtggttgttgttttttaacttggcttccctaagaacgaaccacaagagttttgtgattctttcaaaaataatatgccaaaatgcctttgtgggagcacacacacacaaatgcatgtttctgtggagaaggatccatagctttcaacaaatcctcagagggttctgtgaccaagaaaggtaagaacaaggctttaactgatgagtttctttgtggggtagataagggaattagagcaaatgattgccaaagttttgtctagcaactaataaggtgggtacagaaagaattgactccattttgtatctagagagactggaattcaaacaaaatcattggctcccttcaatgattcgttgaatgggtgatgaaacttgagcctgtagttgacgccttctaatctgtgctctctcaactataaccacactaggcagagatttggaattctgatataaaatctgcccagtcaatataggccaaccaagagagctgttcgcttaagtgtgcccttccccacttcgtcctcaagtggagacctaatccctacatcaaccagaacataatccccaggaagagatggctcttcacatcctattgggaagaaatctttaaaccatttcaggtgagtcaacagatcacaccaacatctcttcacagttgttggtatgtatttcattaattaacacatatttccaggagcccttatttaggttgggaactgtttcctccagtcctgaggaatctgagctatctacagaagttatgagctatttaagtgggatcaggatcagcccattgctcctgctatggtctgaatgtgtcctcccaaaattcttacgttgaaacctcatctctgatggcattcagaagtggggcatctgggaggtgattagatcatgagggctctgcccttgtgaatgggatcagtgcccttacgaaagtggcccgagggagcttctttgtccccttctgccacaggatacagccagaaggtgtcatctttgaagcagagagcaagccctcactagattctcaattttctggcaccttgatcatcccagccttcaaactgtaaaaaataagtttctgttacttataaattgcccagtctgttattttgttatagcacccagaacggactaagacaccttctgtgtgtattctttacctgagttgacaagtaagtgtctttattctgttatgttttcataaaactcagtggggtagccagagtgtcatccagcagtcccatatctggcagtcttatggtgggcatttcagggagacctcattcttcatcttctgttagttcagcttgcagggacagctctcctatttttagagaatcatttttatttgttagtcacttagtttccccagaggtatcctttttctaacagcgttagaggcattcacctttctccccactagtaagatctgtgctgtttcattttacatctttttttttttttttggttgggggaaagggggctgatcatcaaatgagttgacaacattgggtgcatgatccaccctgcagacgttcgctgaatgtctaccatgtgctaggcactggaaatgcaaagacacaaatgtctgccttctgtaagttcacaggcaagctggtgaagaaatatttaaacaaaattatatcagcgccaggattaaatctgtgtggaatacagagccaaggcaaaagaggtaacagtaggatgggtttgttagtcatgactcttggttgcaagtgataaaaacccaactcagagtagcttgagcaaaaaagggggacttgattgactcacataaatgagggtagtaccagcttaaggcacagttgaatccattggcctaaattacctggttaccccaactccctaatttttctttctttctttctttctttctttctttctttcttttctttttctttctttttctctctctctctttctttctttctttctttctttctttcttttttctttctctctccctctccctctctctctctctcatcagaagaggtcttttacgctgttattgcaaaagcatagatgtttctacagagttttgataggataacattttcacagtgattatgaatttacatcgtccctagaattctaaactactgggatctgaggccgtaagttgtttaagagtattctgacattaccttagattcagcaaaacttgaatagttgatcatgcctttcttagaagaaaatatctgtaatttctcagaacaatatagaatgagacagaaaaactaaccatccctatgtgccttattttaagtgatatatttgtatcctgatgggtttctaggtgttggaacacaggtcatgaatcatagaacaattagaataaagtgttcgtctttatcagtagcttaattctggcccttgatttaatgtcaacaggggagaaatgtgtgagaggggatgaggtttgccaattaattgtcattatgtctttggaggtcttgaacctgatttgttattaagaagtgaattctacccacttaaggcatacatttgctaaaggtgacctctctgcttccacgttgttaagaaatcgtgatttttttcaaaacaatcatcagctttacagtttttgaggaaagatctagaagcctgttaaaatggacttaccaggcagggttcagcccaggaaacacaagccactctgggtattctaaacagagagagattaatgtggaattcaggtgtttgcaaaggtattggaaggctggaggagcaggcatcagtctgagctccaggaggctgccacgtgaacggtggattcatgaaaacatcatcattggctgcaatcttagactgaggatgcagctgctggcatcccggcaactgactctcaagcacatggaagctgggagttatttgctgctgcccaaaactcagtccccacagctacacttgccaggaacagtagcttcaggaagatagcctggatttcactcatcttccatattgcacatgtgtgtgtgtttcattgatggaacatgattcacgctgagagctttagctgcaagaaagtttgggaaatatgtcttctctgaggcttttggtctttgcagttcaggagcagttaggaggtgggactggttggttgcagagtgagctgatttactgcacttagtctagcttattaaaggatgagcttataaacaccccaggtaatatcacaatacataagtgctacctaattactgtgtgggtctgttaccaagaatgtctaagtcaagaaattgaagattgtttccttcagattctgcatcctaatgtagaatctttcctattagagtataagtaaattattttggtgtgttatttaagaatatttgtgaataggcttaattaaacaccatgttaagaaattataaacttaaggccaggcacagtggctcacgcctataatcccagcactctgggaggctgaggcgggcagatcacttgaggtcaggagtttgagaccagcctggccaacatggtgaaacctcatctctactaaaaatacaaaagttagccaggcgtggtggtgcacacctgtaatcccagctacttgggaggctgaggcaggagaattgcttgaacctgggaggtggagcttgcagtgagctgagatcacgccagttcactctagcctgggtgacagagtgagactctgtttaaaaaaaaaaaaaattataaacttaaaaaaaaaatgttttcctttaaacaaaaacgcatgttccttgttttttgttttgttttgttttgccttttttgagagacagtcttgctctgtcacccaggctggagtacagtggcacaattatggctcactgtagcctctacctcctgggcgcaagcaatccttccacctcagcctccctggtagctgggactataagtgcagaccacaacaactgattttttattttttgtagagacagggtctccctacattgcccaggctggtcttgagctcctgggctcaaccgaccctcttgccttggcctcccaaagtgctaggactataggcgtgagccactgcaccaggccgtttctttttttttaaaactttggaaaatatggatgaatgaaagtgagaaaagtaacccttctgttattctaccaaccaaagctaattgctgccaacattttaatagatattccttcggttgttttatgcatgtatgattttgtacatgtgtctactttaaaatatatagtctttcaatgttgcccaggctggactcaaactcctgggctcaagtgatccatcacctcagcctcctgcatgtatctacatcttattttattttatttttagagacattctgttaaccaggttggagtgtagtggtgtgatcatggctcactgcagcctcagcctccctgggctcaagtgatcctcctgcctcagcctcctatgagtagctgggactacaggcatatgcctccatacctggatactttttgtattttttgtagagacatgtttttgccatgttgcccaggctggtctaaactcctggcctcaagtgatcccctttgcctcagcctcccaaagtgctgggattacaggtgtagactaccacgtctggccaacattctcattgatagtctttgcacacatctttcattccttctgggaatttattctaagaaaatagaattttggggtcaaagtacttgtatgtatgtatctgtaccaggaaaaaagcagaaattccagtatcaacagataacgagagccacgcagggtggtacatgcctgtagtcccagctactcaggaggctgaggcaggaggattgtgtggcatgagcccaggagttagaggctacagtgagctatgattgcaccactgtactccagcctgggcaatagagcaagaccctgtctctgaaaaaacaaaacaaaacagataaccattgttactattttgttgaacattttccagataccctgatagaagacagatctgtgcatgcacatacacaattttacataaatgggaccattccatataggccagtatctagtgtgtactttttttactccacaatttgccatatacgtctttccaaatcaatcaacatagattaaatcatatcaactacacaggattccatcatttgtgtgtgctcttgaatcctacttttaaaatgttctcagaaaggttatcctgaaatatattcctatcagaagttttccacactctctctaaactgaatggcataagtgaaagactagttgttaggtttaaaaaaggttatctgttttaattggaattttttttttgaggttttctttttcttttttctttttctttttttttgagacacagtttcactctgtcaccctggctggagtgcagtggtgcgatcttggctcactgcaacatctgcctcctgggttcaagcgattctcctgcctcagcctcctgagtagctgggattacaggtgtgcaccaccatgcccagctagtttttgtatttttagtagagacaggattttgccatgttggccaggctagtcttgaacttctggcctcaagtgatctgcctgcctcagcctcccaaagtactgagactacaggtgtgaaccactgttcccagccttaattgaattattttattgctaaagtgattgtacatttgcttcatatgcttatcagtcatttgcagtttgctttttcatattttaccttagaccatttttatgtgggagaagccttttattaaattagtatgttctccttataaagttagtaatttttaacatgtgttgcagacatttttcccaagcttgttatatatgtttgacatgcagaaatcataaatatttacgtggatcaacccatcaatctttttctttattgtttctagattttatggcatgcctagatagcttcttttctactataagattatacacattttcttcaaaaaattttttgaaacatttatgattgttatatttgtatttaaatctttaattatctaaaatttagtgcatggtatgaatggatctaactgattcattttcctaaaatggtcagctggttgtcccaacactattgatttctttctttcccatcagtgacatagatgtgatctttattataatatgaaattattattcctgctagcattacctgtggactttctggtctgtttcattgttctatatttattgctgagccagaaccatacagttagaattattataactttacatctgataggaaaagtacccctatatttttcttcattaaaattgtttttctcagacatctttgcccatctgttcttttttattccccattaagagtatatgttgcagtgttttttagtatattcagagtgtgtgaccatcagcacactcaattttggaacatttcatcacccccaaaagaatcatccatagttacattaactataccaccccacagctcttccttaagaggagctaacagtcgctcctccatacccaccccctttcccccaaccctaggtaaccactcttctacttagtggctgtatagatttcactattctgacatttcacatgaatggaatcatacaatatgtggtcctttgtaactgatttctttcacttggtatagtgttttcaaggttcacacatgtagcatgtatcactacttcattgtttttattgccaaataatattccattgtatggatataccgcattttatgtatctattcatcagttgatggccaactgagtttttcccactttttggttatttttaattatactatcatgaacatttgtgtgcaagtctttgtgtggatgtatattttcatttctcttgggtatgtacccaggagtggaattgctgggttgtatggtttaaccatttgaggaactgccaaacttttctaatgcaggtgcactattttacattcccatgagaatgcattggagttctgatttctccacatcctcaccagcactttttattattatctgactttttgattatagccatcctagtgggcatgccatctgttcttgagataagtttagaatcatttttatcccattgatatttttaatgagattgctttgaatttatggatcatttggacatgttttcagtggttaaggcttactatttaagaagagcatgctttttcaattaataaagtattctttaatgttccttagctttagctttatttagcagtccacatttaaagggtattaactatggaaatttttttttttttgatacagggtctcactctgttgcccaggctggagtgcagtggtatgatctcagctcactgcaacctctgcctctcaggctcaagctatcctcccacctcagcctccttggtaactggggctacaggcatgtgccaccacacctggttaatttttgtattttttgtagagatggagttttgccatgttgcccaggctggtctggaactcctgggctcaagcaatccacctgcctcagcctcctaaagagcttggattacaggtatgagccatcagccagtttttttgtttttttaaatcattgatttcaactatgctctgttgaatcccttttccatcccctcatgtctcacatgcctcacataacttcccaggcattgtgttttagaaagtctggtattgtttaaattctaacctcattttgctcttctccagagcatgtccagctagtcactaaagggacttggaatggggaggagataggtgcacccttcctttcctttgactccagctgttggagctggagggagggcgtgaactggcaccgaggtgaattctccccattccttcccagcttcctgaggcctagctcctccatgagctggggagggagaaaagaaggaaaggggacagtggtacttaccaggcagctaccactgtggtcctctcctttgatggactccgcttttctagccagtacttaactgctgatgccttctgtgcagcaggcgttgagtactcctctttctggggtccatgtgagagttctttcagagctcactcttctatgtactctatgtactcactctatcttatgtacacagttgttttcatgggagatgcagctctgtctggtctttcctgccccctccactctctccaactgtacctcctttctccatcttgcaatctctctctgattcacttcactcgtgctcagacaggcatggagagcaggtcagcaaattcttcacactatcagactttagacaagctaaggaatttccttctctgcatactgtatatagcacagtttgatttatgtaacatcctaatcatactgtctggaagaatcttaccaaaatgatattattcccctacatggggaattagggcttgattttaccttctttattataattatttttacttgatcaaattactaggaaatattcctccacttctaaagaatacaatttccctgtgttagaaagatcagttctggtgtggtggctcactcccgtaatccctgtaccttgggagcctgagatgggaggattgcttgaggccaggaattggagaccagcctggacaacatagcaagatcttgtctctataaaacactaaaaaaaaaaaaaaaaaaaaaattagccaggcatggtgacacactactcaggaggctgaggcaggaagatcacttgagcccgggagtttgaggctgcagtgagctatgatctgccactacactccagcctggatgacaaagcgagaccctgtctctaaaaaaataaaaccaacaacaaacatacataaataaaaagatcacatccaaataatagaaaaagatgatatggttttggtccccaaaactgacatcatgtaggagatattggaactttgtgggtgggagccaagcccattctggtgccccttctctaggtcacgtctatactgcttgtttggattccttggcaaaaactgattatgcaaggcagtaggatgcctggctcaaattgggtcaatcagatcctttttcttggaatttaaaaaaaaattgcatgaaaacgtatagttaaatgcacaggtcttaagtgtacaatttagagttttgacaaatatatacattcatgtaactgaaccccaaacaagatatggagcatttccatcaccctagaattttcattcatccccacttccagtcagtctcctccatccatgatggccaaccactattctgatttctatcactatacactagtttgatctttgtttggacttcatgtaaatgaaatcatacagtatatattcctttgtaactggctttttttaacctaagaatgtttttcaggcttatccatatttttatgtgaatcagcagtttattcttttttattgttcagtaatatatcaatgtgtgaatatattatccattcgcctgttgaaggtcatttgagttctttccagtttcgaactattatgaataaagctgctaaaaacatttttaaaacaagtcttgttgtggacataagtttttgttggggcagggatttaaatagctaggactgagattgtcagtttattggataggtatatatttaacttgagaagaatctgccaaacagtgctccaaagttgtgcaattttacactctccgcagccaaaatggaggcttccagttgttgtacatccttgtcaacatttgagatgtcagtcattttcactgtagccattctagaggctgtaaagtggaacctcctggttttggtttctctttcactgatgactaatgatgcacaacttttcatgtgctcattggccatttgtataccttcatttgtgaagtgtctctcaagtcatctgcacatttatcttattgggttgtttgtctttttactgatcagacatatgtattctagataaaagtcagatatatgtattattgatatttcaaagcattttgttcagcagtagaaatgctggctatatgatttgagaataaaaatacgtatgtaatcgtaacaagaagtcttaaataaattaaaatgtcactattttgaataactagaatatatattaagaaaaataatcccaggaaataaaaaatatgctagtaatatattaattacacataacaaatttacaaaattatattaccatataacagtaatacataattctaaataaaaataatcatgctcacagataaaaccaaaaactttaagagcttaatttattgaaaggaaatgatttaaatatcatgagggaaataaaaggagacaagaagtagtggaacactctactgtgctcctgctgtttgggaagatgtactatacagagttaattcaacaataaacaaagtccctgagggatggcctatacaagttgacaagttgatgtaaaaattaattgagggaattaaacagaaatgtaaatattccaataaccatcgaattatacattttaaatggatgaatcgtatatgtgaattatatctcaataaaacgattataaaaaaagaataaacagggattttttttttttttgagacagagttttgctcttgttgcccaggctggagtgcaatggcacgatcttggctcaccgcaacctccacctctcaggttcaagcaattcttctgcctcagcctcccgagtagctgggattacaggcatgcacctccatgcctggctaattttgtatttttaatagagatggggtttttccatgttggccagactggtctcagactcccaggcttaggtgagcctctcgcctcgctctcccaaagtgctgggattacaggcgtgagccactgcgcctggcctaacagggaaatatttttcaagttaaagcaaaaaaacaaggtaagccaagtaaaactatataaaaatatatgattttggtgtttacagcgcattgggtaaaaaatcttactcagaaacagtatgtaaaatatttcatttttagaaaactatacattaaatcaatggagagtggccaaaaaattttaacactgtttatctcaaggagctacaactatggtaaatattttccttaataatgaaatgtggaaacatttctgagaacagaaataagacgaagatgtccattatcatcacttgtattcaatactttcctggtattcctaacaagagtaataaggcaaaaaagttgaaataaaaatactaagattggacctaagatacaaaactatgtatgtatattaacaactcaaaagaatccagagacaagttattagaattagtgagtttagcatgactgaataaatggtcaaaataggaaaaccaattttatttctgtataccagcaagagttagaaaataaaacattttaaaacaataccatttatggtagcataaaaattcaaatgtctggggaaaaatttaatgaaagatgtccatgacactttaaatattatttagagaaatgagagaagaggtaaataaacagaagtacataccatgtgaactgattagatgacccagtattttaaagatgtcaattctcccctgaattgacttataaactcaatgcaaccccgggcgcagtggctcacgcctgtaatcccagcactttgggaggctgaggcgggcagatcacgaggtcaggagatcgagaccatcctggttaacacggtgaaaccctgtctctactaaaaaaaaaaaaaaaaaaaaaaatacaaaaaattagccgggcgtggtggcgggcgcctgtagtcccagctactcgggaggctgaggcaggagaatggcatgaacccgggaggcggagcttgcagtgagccaagatcaggccactgcactccagcctgggcgacagagcaagactctgtctcaaaaaaaaaaaaaaaagaaatggaaaaagaaaaaaatctcaatgcaatcccaatcaaaatcacaacaggcttcatatatatatatatatatatatatatgtgtgtgtgtgtgtgtgtgtgtgtgtgtgtgtgtgtgtgtgtgtgagagagagagagagagagagagaagttgcatggttaggtggtaaaagcagtgtttgccataaaaatcaggtcgttggttattttggtggggagggagaggtagtgtttggaaggggacacaagggaaggttttgggacgcatggtataccggttgtcaatgtatggcctcgcacctccaaatccatcctttaatacctgctctgtgggcacagccagaatccccttccgcggctcccctcgcggcagggaggatgctgaacagtagagggcgctggagacacgctgcgggaggctgtcgctcgggtccggctgcgggccacaggccgcggatcgcgctctgccagcgccccacgcccgcaagcgcggcccctccgccacctcgcggcccggcctgacctgttaatcacgtccccacggctctcctagcggggacaccgccgtctgcaggctccgtccccacagtgcccagaccccgggaagtttgtcagtcagcaccctgatgccagccgattctcaaaaagccaggaggatccaagcagatgatttgccagacggtactgcagcaatggagatgaacagataattcacacagaaagaaggacggtagggagagacgtgcggggggtagggagggcggaaggaaggtctaggggaaggagcggagggggaagggaggaaggaaggcagcaatggaatgaaaggagaagggaggaaggactcgttgaatgcacagcctccccggtgctgcaccgacaggagcggctctcacaggcatggggcccccaacagaccctaccaggctgcgggaatgttgcggccctgcagggcgtctctgtcttttttgaggtgtctctggtaatatgtgataatgacagtatttttagacatttggaatctgatttaaattttagctccatcaccttctagctgtgggaccctgagaaacagcacatcctcccggatcctcccatctctcttgtccacacgtggggaaggctcctggtgggggggggttgggggggaggggggaagggggggttggggggagggggaaggggggggccttgcagatttaccaagctgatgtacaaagacctactacagcggtaagggctagctcctttctcccactctggcagtcactccactttgagaaacatacatcttgaaataaagctacaagtggagaggggcaggtgatttgggcaaatgattccatactaaatgttaggacaaaacatcctaggcaaatatcacaatccggcgtcatagtggcatactaaattcaaccaagaaatatacccatgatgttgaaagagccaggcttatggaatgtaaacagcaaactattttattcttgttttctatttaccaattcaaacttactctgcaggtcactcctccctgcccctgggataaaatctagggcatgttctgtgactttctggatcacaaaattcacatgatttttggatcattctcagttaaccaaaaatgtgtcctgtaacttctagctataaaaataggctctgttcagcatttaaaatgtccaatcccatgtaggagtctaaactttcgatttcattttaagtttaagcttcctcttgattcctcccccaagtctggcccaggcttgcatttggctccaggcattgggcgggtagcagtgtttcctctccatttttcactttcactcttccctccccaactagcttgcagggatttctgatcacctagtagagtctagaggcgtaagggaaggaggtcaccaaggggcaggccaggctttatgtgaatagtgctgttgtgagccaagtacttgagtacttcgaggtccccttctactgcagacatcttccctatggttcctgtgacccaggtttgtctcagagtggggttagcacacggtaccatctccatcccctttaaaagtatttattacatttttctggaaatggaagtctgggaattatatttccctgatagtcttatgagcaggattccaggttgattctgccaaatgtgaggcactcaggtgagactagaaagcagaaagatggtttaaaaaatcatcgttttcttcctttgactctgcacttatgacagcaggatgctcgagactcttgcagtaatttgggcaaagatttccacagtgcaaaatagaaaaaacgtaactggcaaatagctgtacaaattacagtccattttcatcatggaatgtcagtttggcaacaatggcatcgaggcccaaaagcagctctgcagtaggggggttcctccttggtgactggatgggcacagcgaagcacaaattcctgaagatcccagctccaggaaacatcagcatggttcattgcgttgtccacctgaattcttcacccctccctgtggctgtgtccattgccctgtagtgttgcagttcccctcaggaaaaagatatcatttacttctctgacccttgatttggagcttggctatgtgacgtgctttggccaatgggatattggatgacataacataaggagagacacagatatgcatctgcacaatgcagcttgcctttttatgcttctgccttcaccatgaaaagagctttccctgggggtagcagctgtccctgcagcctgtgttcagaatgcacaaatgtgaggagccaagcccagccagcttgaaagtgagttgccaggcccagcgcagtggctcacacctgtaatcccagcactttgggaggccgagacaggcagatcacctgaggtccggagttcgagacgagcctgaccaacatggagaaacccccgtttctactaaaaaatacaaaattaggcctggcgcagtggctcacgcctgtaatctcagcactttgggaggccgaggcaggcggattacctgaggtcgggagttcgagatcagcctggccaacatggagaaaccccgtttctactaaaaatacaaaagtagccgggcgtggtggcacatgcctgtaatcccagctacttgggaggctgaggcaggagaatcgcttgaacctgggaggcagaggttgcggtgagccgagatcacgccattgcactccagcctgggcaacaagagcaaaactccgttgaaagaaagaaaggaaagaaaggaaggaaggcagacaaaattagccgggcgtggtagcgcatgcctgtaatcccagctactcaggagactgaggcaggagaatcacttgaacctgggaggcggaggttgcagtgagctgagatggcgccactgcactccagcctgggcaacaagagtgaaaccctaaaaaaaaaaaaaaaagtgagttgcctaccctagctcagaccacctccagccaacccacagatgtgttagaaatgagtgcttatttaagtatggcattgacatgttgtgattagttgttatgcaccattatagcaaaaaaattgcacactgataaaagtaactgttccctcgttggcttcaccagctttcccaagaattgtttaatcccattccctgtataaaatcactctctgctgagaatcctttttctgagaaaagaattctgagaattttttttctgcttgaggcagaccaacactcattccaagaacaactggaaaggctgaataaaacacagaaaacttttttaaaaagtttttggaaagcttcccagttaacaaacatttgaagggtcataatctcaaaagaagaaaaacacaaggaggcaagctggccctctgtgaactacttttcccttcaggaaacgtgctgattttagctaagaggccgagcatttgggcagacggccatagctaagaggcagcaaaggcagcagagtcgtcttcagctggagagacaagaaatggagactgaggttgtcaaggcagctggaactgaaggggccgagatatcatgtagaagggagacacagaaaaggaacactttccccttgaggcatctgctgagttaagctatgcagaaaggctatgaaaagcagcaggttttggcagtgtcatattaatgagataaaagttggagttcaggacccaccaaggaaaagaagcctaataatcacatcagacactcagttggaatccttggaggaccacactctagatagacgggcaaaccagagatggagatgaagccttccaaaaactgcaacatagactctagtcagttcggtaccattggattaaggtaaaatcttcccactctgtctatcagatgacatggtaaaccctcccttgagacagacattgttttcagatcatgtttcctggagccactaaaatttattataatggttagcattcaacaataagtgatcaaacacaccacaaaacaggaaggaggggaaaacagacacaacaaaacggagccactaatgacccagatattggtgttatcagacacagacttgatgggtggaatagagactttcatcaaagaactggaatctataagaaagaatgaaatggaaatttaaaacttaaaaatacaataattgaaattaactacttagcatatgggttaactacaattagatttagcagaaggaacattctttgaactgtaatataggacagaataaaaactctaagctgaagaacagagacaaagagtatggaaaatacagcaaagaacataagatacttgtgggaggtggtgaacaggcctaacacatatgtaactggagtcttagaagggaggaagatggggcagaaggaacagttaaataaatatagcctgagaactttccaaaactgataaagctttatgatccccaagcaggataaataaaaacaaaactgcatccaggcacactatactttttttttattattattttttgagacggagtttttctttgtcacccaggctggagtacggtggcgcgcgatctcagctcactgcaacctccgcctccccaaggtcaagcgattctcctgcctcagtctcccgaatagctgggattacaggcacgcgccaccatgcctggctaatttttggattttttagtggagacggggtttcaccatgttggccaggttggtctcaaacttctgacctcaggtgatccactggccttggcctcccaaactgctgggattataggcgtgagccaccgcacccaacccaggcacactatacttaaactgctgcaaatgaaagacaaggaaaaaacagtaaaagcagctagaggcaggtaggagggacacatttcttcttttcttttttcttttcccctccctccctctctcctccttcctgcctccctcctgtcattttcttttgtagaggggggggatcttgctctgttgcctgggctggttttgaactcctgggctcaagggtgctgggatgacgggcgtgagccagtgcatgttactgacacattactctcaaaggagaaacaatagcactgaaaatcacttgtcaacagaaatgatggaagtgagaagataatggagtgccattctgaagttcctcaaagaaaaaagtgtcaacctgtaatcctatattcacaaaatatacttaaaaatgaatttgaaatagatgtttctattcaaaaactgagaaaggctgggtgaggtggcctgtaatcccagtcctttgggaggtcaaagcaggcagactgtttgagctctggagtttgagaccagcctgagcaacatggtgaaatcccttctctacaaaaaatacaaaagaattagccaggtatggtggtgcctgcctgtagtcccgctactcgggaggctgaggtgggaggactgcttgaacctaggaggttgaggctacagtgaaccatgatcatgccactgcactccagcctgggcgacagagtgagaccctgtctcaaaaacaagcaaacaaaaaaacacaaaaaaacctgagaaaatttgctgccagcagatgtgcatacacaaaaaatactaaagggaattcttcaggtagaagaaaactgatctatgatagaatcacagaaatgcaggaaataataaaaaaaaacagagtgaatatgtgggtgaatacaaatgaatattgactgcacatagcaataataataatgtctcgttaggtgtaaaatatatgtgaaattaaaatgagtaataataatatacatgcaagagtagaatggaggtaaatagagattgagtattgtgagatcatagcattgtctgggaaacaataaaaagtaaaatttgtattagattataataatgtacagaagttgtaatctgtggaggaaaccactaaagaaattataaaagaatgtgtaagtagaaccaatggtagggggggaaacggaattaaaaaaataatcagaaagaaagcaacagaaaagaaaaaataaaaacaaaaatgggtaagacaaatggaaacaagtagtaagatggtatttatgaacacaactatatcagtaattacaataaatgtaaattcacgaaatacacaaaagacaaaatttgacagacttgattaaaacaactctattcaagagacatgacatcattataagaacattgaaaattcaaaaataagggggaaagtgaaaaaaataccattgtgagtggtagagaaagccatttcacataataaaggttcactctaccagaaaacgtcaattttaaatgggtatgagcctaataacacaacctctaaatgcataaaacaaaaactaacaaaactcaaaggagaaataaacaaattcataataacagtggcaggctttatcctctctcagtaatttatagaaaaacagacaaaaatatcagtaaagatgtagataatttgaccaacctgattaacaaacttgacccagttgaaatacacataacacctgcacacaactgcagaatgcacattctttcaagtgcaagaacattatgataagaatattataggaaagtctgtcataaacatagcttatataaaaatataacagcaaattaatctaaattttatttatttatttacttattttatttttttgtttatacttatgtcataaacatagtttatataaaaatataacagcaaattgatctaaattttatttatttatttatttacttattttatttttggagacagagtctcgctttgttatccaagctgtagtgcagtggcgtgaacatgactcacttcagccttaacctcccgggctcacgcaatactcctgccccagccctccaagtagctgggacaacaggcatgtgacaccatacctggctaatttttgtggtttttgtagagaccgagtttcaccacgttggtctcaaattcctgagcttagacaatctacctgccttggccttccaaagtgcggggataatagatgtgagccactgagctcgacttaaatctaaattttattttattttattttatggccatgctccctctaataaatctaaattttaaataaataagtccaagtattgttgtgtttatgtgtataaacctgcgcacacacacaaaagtgtacacaccctgctggtttctattacaagaatgttaagtttggtttgacattcaacagtcaattagtataagtcatcacatccaaagaataaaggagaaaaataaaattatttcaaaaggtgcagagtaagtatttgagagaaatttaaccttatttgtaattaaaaaaatctttttaacagcttgagaatatatgttaatgagtacattaaaaatcctataacaaccatcaaacttcatggtgaatattgacaactctccacatgccacacccaccacccctgagattgaggatgagacaagaatacccactatcactacttatagtcagcattctgctggaggtcctagccactgcaatttgtataccaattttatatcttgcaaccttgccaaacttattagctctagtagtttttttgtgtgtggattccttaggattttccatagacaagattatgtcatgtgcagatatagttttacttctttctttatgatctggatcacttttatttctttatcttgtccaattgctcagccactgcagtttggcaagagctaaataaggcataaagattaagaaaggaagaaataaaactgtcattcacagaggacatgattatacaaaaataatctgcaaattattacaatttaaatgaatgtcacaaagcctctcactggataacaaggtcaacatagttttgtagcaacagaatctgtatatactagccataaacaaatataaaacgtctaagaataaatctattgaaggatgtgcaagaacactttactgaaaaccacaaaaatagttctgagaaacatacaaaagacttaaagtgaagagatataccatgttaatgaataggaagattgaatattttaatgatgtcaaatggcccccaaattgttctacataatcaattaaatccaatcaaattctagcactttattttgtggaaattgactagctgattctaaagtgttttatggaaatgtaaagggcttctttcttctggagttgccttgtggacaggatttgagacaacccaggccaggtttctctggtccatgggaagcatgcgtatgctttttgccctgactatgtctgtagagaacagcccaaacaacaacctcctccccatcagagcagagagccagctagtctcttgccatttagatttttcagggatgagtcagagataccagtctactctgtcctgcagaaaaggatacttatcaacttttccaagcggccctagaaaagtcactgctagtcagaaatctcaccttggaatgtgggggtggctggcatctatccggatgtcagatgaaacagaaacagttccactgtagtagcctgctctataaacacacagagaacccctattacatgtgagctatgaagctattagaaactacagctttgcggactactttgaaaatgtgcaagtgggccgggcgtggtggctcacgcctgtaatcccagcactttgggaggccgaggcgggtagatcatgaggtcaggagatcgagaccatcctggctaacacagtgaaaccccgtctctacttgaaaatacaaaaaattagcagggcgtggtggcaggtgtctgtagtcccagctactccggaggctgaggcaggacagtggtgtaagtaaacccgggaggcggagcttgcagtaagcctagatcgcgccaccgcactccagcctgggcgacagagcaagactccatctcaaaaaacaaacaaacaaacaaacaaacaaacaaaaaatgtgcaagtgaaataagtgacaaaaagcaaacacaagatattctgttcatacgaaacactgcgaggcgacacttgtgtttgtagattgacagaaattggaggtggagttaaagaggtagaaactcagtataacattcattgcctcttttgctaaagttgtttcactgcataagaaaaagatactggtcgggctgggtgcggtgactcatgcctgtaatcccagcactttgggaggctgaggcaggtggatcacctgaggccaggaatttgagaccagcctagccaacatggtaaaattccgtctctactaaaaataaaaaaaattagccaggcatggtggcgggcgccagtaatcccagctacttgggaggctgaggcaggagaatcgcttgaacctgggaggtggagggtgcagtgagccgagatcacgccattgcactccagcctgggtgacaagagggaaactccgtctcaaaaaattaaaataaaaaaaaaaaaaagaaaaagaaggaaaaaagagaaagagatagtggttccatgtgctgttctagttacacaaaacaacgtgttgacgtgcaggctgcacgatgccaggtgcaaatacacactacctgttacagtaactgtgacaagcacaagggctgctcactagcttgagtgcaacttctggggagttgatggcagtgatctgtgggtacttccttcttaacaaattttacatcaatactgcaacacagcaatctcagccctgtgggctataccatagccacatgctttcaccatttcctgctcaaagggagagcccaggaactgaatgctcttaatcagggagagcacagaaacagcagcagaacagctggagaaccagggctgtgtggttttggactgtggggagggtgggccatgggcagacttgacacaatgtgggagggcatttgacacagccccgtggaggacctaatgctcggggaggccttcacccagcacagtgagccatgccgacacttggtgcctgagtgcgctggtcacagcgccctccctgtgattttccccatagcagtgtgttttctctgccaggcagaaggcagagaaaccctggctgaaaaagcagtgagggtcatcgactgcatgaacacatcatcagctttcccagatggaggcacccaagtttaccctgcaggtccattcagcaggtagagctgggtcatcactaaacaggatctttcttctgagcatctgagattctggtccaaatcagggctgtgaggaccaggagccgggattccgagcccaggcagccccgcagataaggaggagggagtgtgtcggaaggctgtatggccagagccgctgaccgggccagggcttctttgtcccctcttctctcctgcatatcagcactcacgtcctcctggctcgggctggctggcagctcggggagctgttggatgaaacgtccatgcgtgtggctgtggctgtcacatgcaactgcgaggatggtcggctcccaaagcggaaccgcggtgctgggcgaagggtcagggctccgtggtgcggcagagcgcatgccagcgcttcaccagctccttgggcttgctgagcatctcgtcccagtgctccagctctctgccgcgggtgtacatgtaggggcccaccaccactcggcccagctgctggctctctgcaggggagggagagcaccggtgtgctcctgagcacagaagccccgtccccagtgacctcctttcctccctcctcctccccaggaggaagtagcaactcccctcctctctgagtgggagctgacaggccccaaaggggccctgcctttgctctgcagctggaagggctgcttctccccctgggagattgggaggaaggagagccctgaaagactctctccttgagggccaccagctctgccccacacccttctgtggggccgtattaagtctaccttatgccaaagagctgagggaggaaagggcccctctagaaagaaggcctcggccatccgagagtacattcagcagtaacattcactggccaccgtggagaagggtcttaagtccaggccatgtggccagccacggcctgatggctctgtttccccagagtggcagtgggtgctggggtgtggggcagtgtgggagctggctgacagaactcgcccagaaccccaaagtctcatctggagggcacgaggaaggtcagagcaccaggtccctgggctggtggcaggcctggcccctcccactctctcgggtgatttgctccaggagagggcagcagaggccattgcttaacctctttctttttcttttcttttcttttttttttttttgacagagtctcgctctgtggacaggctggagtgcagttgcaagatcttggctcactgcaacctctgcctcccgggttcaagtgattcttctgcttcagcctcccgagtagttgggcctacaggcgtgcaccaccacgcctagctaacttttgtatttttagtacagacggaattttactatgttggccaggatggtcttgatctcttgacgtcgtgatccacccctctcggtctcccaaagtgctaggattataggcgtgagccaccgcacccagccaacctctttttttttttttgagacgaagtctcgctctgttgcccaggctggaatgcagtggtgcgatctcggctcactgcaagctccgcctcccaggctcatgccattctcctgcctcagcctcccaagtagctgggactacaggcaccagccaccacacccagctaattttttgtatttttagtagagacgtggtttcactgtgttagccaggacggtctcgatctcctgacctcgtgatctgcctacctcggccttccaaagtgctgggattacaggtgtgagccaccgtgcccggcccttttttttttttttttttttttgacagattcagcagcctcgcctcctgggttcaagagatcctcccacctcaacctcccaagtagctgggattacaggggtgtgccaccacgcccagctaattattgtatttttagtagagatgagcgtttcaccatgttggccaggctggtcttgaactcctgagctcaagtgatccacccaccttggcctcccaaggtgctgggattacagatgtgagccagcatgcccggctgcttaacctgtttctagggtgccacagacagagctcaactggactaaagctgggcctgaaacccaggccttgggcaatatttcagcctttctgagcactagtttccttaaccagggagggagctcgtacagctccttctgaggtcaggacaggaggcactcactctgcctgaacactcggcagcccctcgtggtccccatcccagcagcccagggtagggtgtggccttactgtccccttccatgttctgcaccacagtcaggctgaggctagcggtatccagctcggtggcatcggccttgaagctgaaggtctcattgtacacagggttgatggagcccagcacagctgaagtcttcttgcacttgacaaacttgttgtggttcatcagagacactttgacaaacacacctagggaacggtgagcactagtgggctggcagaggcaggtgggagcagagcccctgcctgtgggaggtccggctaggagggcacgtgcccaagctaggtgccagggccccacccctcacacagtgctgcggccccgccggcgtgaccagaggaagccggctgaggagtgcactgccctgcggcccaggcggggctccgctcccttccttttccttcctctttgcatcaggaaagtacccacggctcctgcaggccctggtttaccagagcctagcaccgcaagcctgtccctccctgttggggggctgctcactgggcccccaggccccctggggccccttaaacaccttgtacagagggctaagatttggtgggtgagggtcagagtcacagtggaaggtctggatcctgcctggcttacggtgaccccagatgtgaacacaaacaggtggctgaccaccacctcactgggatgggtgggatgtgtggggtgagcccaaatggggtgggacatgtggggtgaaccaaggcctccccttctgcagctcctgtattctgggaggccaagcatcagtgcccattgagtcgggggctcttcccctgtggggagggaggtgcgggcctcaccctggaggaactggacccatgccgctgatggaaaggtggaggtggaggcaggcaggacagttcaaagagccaagacgctgcctcgggaaacaggaggggcagggcctggtattgcggctgggttagaaccctccgtaggggaggccaaggagatgcagctttgggttcaacacaggaagaggcttcctgcaccagaactgtcgaccgagggacagcacgtcttgtgaggtagtgagcgctccatgataggtgtatgcaagcagaaactggatggtcagggatgaggttggactgtagccccaggctgtaagctcggtgggtgggaccttccccaggaggaaagggaggaactcactgacaatgcctctgtcctcctggagccggaggcccttggcacgcagcacaaccaccgtcaggcggctcaggtagtcgttgtagctgaggcagaactggaggtcgccaaactccgaggggggctggggaggccaagatggaagcaccccaccctgttactctggcaagtgctgaaggggtcacagaacccccagagagcctcccgcttcctcctagcggtccatgcgacacacccgcatggtcccctttgagttccactgccattttaaggatggggcaactgtggtctggagagtttaaggggcttgtgcagtcctgtggaccagagctaaggagtcacacccaggtctgagccagctggggccttcctgggggtggtgggctggaggaaacatttccctgggctggaccatttgtggtgtcatctctcacagctgtctaacctagataagaatccaaatgtggatatttcaggttgctccagggggtctgatggccagtgtgacaacaggacctcaagcaggccctccctgcccaggggcaggtccgttcccacctgtcccatgctgcttggggcctgggccctcctccctgagtcactgttgtagggtggtgtgcaggatgctgagggctgatgccgccagcaggtgctgggccctgtgcacacctgccagctgatgctcagtggcataggcatggtgaccttgaccatacctccaggctctcggcctccaggtctctccagatgacacgccggcagtcccccactagggtctcattcttcaaggggaagagcacctggcccaggagctggtgcttcctctgcctgtccacgtggtagacggagaacttcagcaccctctgggtgatggtcttgctggacacctgggggggacaaggacaccagccagagtcaggcgtgggggtaggggatgggatggtgtgacttgttattctggacatgggtgcttttgggaacgggtgtctcaaccagggacccacatcccccaaacctaggcattttcaggggacccttctcagcagcagagccgtgtacccctggaaagtgggggtaggtgccaggaccttggtacacagagtgtggtccgaggacctgtagcgtctaccaccacttggagccctgttagaaatgcaggatcttgggccccagcccagattcatgaattggaatctgccgtttaaccggagcaccaagtgacatggctgcacggtgagtgtggctccgccaccaccctgcactgtagcaaaggcccaggagcccagggcaccggcctgtctctgctgtcagagctgggcatgccagctctctcctccctgagatttggcctcctcgcctgtgaaatggggattatgggtcttcctctctggttgtaaaaccccaatcacagtgtctgacctccagcagatggcccattaatattgattttcttttctttccccttctcccttttccacagagggattggatcaagctggggcgagatagagtggggaagtgatgagctaagaaaaattagcctgcaagcatgacgtgtcgcacgtcagcaaggctgcagccttggattctgatgtcttgagaagagcgattcacctgtgaattctcacagccctggcctcagaaagacggcccgggaccaggcccgatggcacccctcttcccagctctcagccagggcggaaggcacaagtgatggccctggcctccgcagtcacactcctcctgaaagctgactggctgaacctcacctcttggctagcttgccacccagctcttgagaacatgtttgtccaaggcctcttggcaggtctcgatgactccttcccctaagggcccccagtcacctgctaaggctcccaggcccctgtgaaactggctcggtgccccaatagactctccacctccagaccctaagccggccagcccagagtgcagcaaggcaccacacctaccctgtgagggcactcgggccccgcgctggcctctgacagcacaggaagcttctgcattcacgctgaggcctgtcttttgccttccttagataaacttgccagaaaccccatagtgcttcaggcctttgggataattcccctgagccccataggccagggcctggcattcagtagttgctctaaaattgtgttttcacccactctcttccaggtagtcaggacagggaagcccaggcttctggtcaccactcaccaaatctctcccctgcccctctatcagggatcagctcctataggccttaacctagcagactaggtaaagcagagctggtggcatcaagggtcccgggggctgcagagccctggctggtacaggaggctgggctctcctgtaggtctgcaccttcccagcaacgcggagggcaccagaccctgcctgctccagaggctgtacctgaaagatgaagtgctcgtcaaactgcgggttggaggttttgcgtttggtcttggattggaggaagcgccgctcatcgggcagcaggtagagcttcaccagggggctgcaggtctccgagggggcttgcaggtgctgtgccttgatcaagcccaccagcagccgctcagcctcctgctcatattccaccgagaaccacagccgccccaggcagccgtcggggaagtcggtctcacttttgtcctccgggaacttgtacagctctgggttgatggcccccaccatacatgcatctcctatgacagagggtgggagggctggcaggccagaggaaggcaggggcatgggagacagtggcaagctctgggcacccatccccatcctggcccatccgtctctgctgagcctcagctagcctgaccacatctgccccactctcctcaccaggctaaacacatcccctctctctggtgcagctcctccaagaagccttctcaccatgaaggcattgcatggccaggctggggatccagcagagtcctgccccctgggattggcccccatccttggaggtcaggacctgtttcaaggacacagtgcccatcacctggcctagcccccttccatggcgtctagggaatgactcagcgataaaacattgcctttcttcttcctcttcaaattagaagggccaaggtgattattgggtggttcctgtgatggtctcttggtagatcttcagggcaaagaggtggcagaaagctgtgtttgcagcccctaccattctgtcctcttggtcaaccaacccatcatcctagagtgggacccagcacaagttctgtacatggcgtgcctgggttccaattccaatctgttgcttacagcctcagttaagactatgtaaaatggggtgataattcctccccctcagagtcatggtgaggtctcactccaaatcagcacccaaggccatatcttaccctcatggggtgcagcaagcacttcataaatgaaagcacccagaaagagtggtccctgggtggtccctggcatccctggctggttcaggttgtgttccggagccaagctggtgaaagcagatggggccacccgagcagaccctgacctctgggcagccctggcaaggacactcaccaaggccgccgctggaggtgtgaggcagcagctctgatgccgggcaggggtcccatggggcatcggcccactctccactgtgcaggggcacccaatctcggccttgaagggttgggggcaccacgaatggcacagctggtggcctgtccagagtcagggagacaacatgtaggtggcaagtcaatggtgtggtctcagagcgctcagccaggacggttgagcaccaggggctggaggaagaaaagccatcgggagccaggaggaggccagggcaccattttctgggcccataccaggcaacacacacacacacacacgcacacacacacacacacacacacacacacacacacacagcagtgggatttgaagaaggaacacagcacctgacagtgtcagccagtctgggtttggattcctgttctgccacttactaattgtgttctctggacctgttgcttatgtgcactgagcctcagattcctcacctggaacatgggtttcataacacctgcctaatagctgatgtgaggtttctggggtttctttgtgatagctcccagcaccgaagcagcatagaagaggcacccccataaacagaactttccttttcgaccccaccctgagggaaattccaggggcgcacttggccccacatcctgcctcacctgctcagttgggtcctagcatgcggctggcagggcctgtcccgctgcccactggaggcagctgtggtggccatggctggtgtcccaggcagctcctcataggtgagggtggcacagaaccttctccacagacagcagcttgccccgatcaacagcagcagcagcagccccccgatggtgcccccaatcaccagggccagctgctctgggggcagagaccaccagtactatgatgcctgcctgggaaagccactctccctcacagccctggcctgctggggcagaactagggcagcaaccctgcctctgggtttgatctcaggagtgataggagcaggcctgctggggatgggttccgggagggatgctgctggctaggttccgccagctctcagaggagaagccgtttaccccagggtctgagagccctgggcagaaccttctagttttccttggaaaacagctggccctgcccttgggattctggcttaaagaagccatttccttgcgcttctgagtagaaatcaaacctgccctcaccagaacctccatatcccctgggctcctgttgaggccaggaggggagctggggtgtggacgcagtcagttaaggaaagccctgaaaggtaccttccccctggtctgcaatcaaacctctaccctctggggccctggaacctgctgcaaggctggactcttctctaacacccgctccctcccctagccctctatcaaggtgagcacgcgcttaggggagttggtgcgacgcggtggacgaggtggggaggaaaagggggcaagaccccgttgctgctggccctcacacgtccgcatttgcgggacctaggaggcttcgccccgggggtgctcagacgctgggttccaaccgctggccacctggggcgggccaaaaaggtgcctcccttagggtgacgtgcggccgcggggcattcaggtctcagggatctgcactgggtggggtggtgagaaggccggaccccccacacctcctaagccgcaactgaccgcgaagagcgggcctcagcgtctactccatcccagtgcccctccaagagcgcgccgaggccgggcagggcaggcgctgcaccccagcgggggcggcggggcggaggcaagtgctggaagggtcgcagaggggccggggctgggctggggaggcgaggctcgcttacccgccatggggctgctcccgcaggctggtctcgccggtctgggcggctggggctgggctgccaggccgtctcttaaagcgccgcggggcgccgtcgggcgagcacaggggcggtccgtggtgctgctggtgcccagctgcggcgcggggagccgcgcagtgcacggcaggggcagggacccagcgccccgaggccgcagtcccgccccagcccgtccctggcccaggcccaggcccggcggtggaggggcgcagagccgaccgtgagctcccggaaaccgcagggctccagccagggcgggtcccgggcgccaggggcgccaggggctccctgcggcttggggcagggtggggtgagagtaccacccccatcccggagagcagggctacagccttcaccgccgcgtctgacacagggctccgcacccgacccctcacacctggtggccaggactgagcccccgccctcccagatcctcctcaagccgaggcccctccagccgcagctccgaccccggctcgggggagccttcccggatcccggggtggagtctccgcgcgggtccccggccccagcgctgcctgcctgatggccttgggcagggatgcggcgctcgcgcacccgttcgctctcagcggacaaaccggtcgagagcgcaattctggagcgggttccagaagctcctgggttccaattcaggctcctcactcgccagccctgcgatttgggacaacttaacgttcgtaagctgggttcagtcttctcaattgggttaatgtccgtgaggggctctcgtaagggcggctggcctgccggtaacttaagaagcatgtaaagagcacttagagcggaggagcggcgcggcccagcccctgttacggtggttatcggatggaggccagcgtcgcctgggtcccctctgtacacccagcgcctattattatggtgattattagaacgcagggcccgtgcccactagtccaggctggcgaacgcgccttgcgggaaaggcgggagtaaggtcgctgcgtgtcctctctggtcacacctcggcgcgccctggtcgcgcccctatggttcccccgccgaggcctcgaggcgtctgagtggggagcgaaaggaatgtgtgtatctgtggtgcaggggagtgtgtgtgtgtggggggggggagggggtggttgtgggggagtgcgtgttttggggggatggaccttctcgttttacagccttgaaggttatgtccagagtcatagcctgggtcccacacccccgcgtcacctgtgcctgtcctagggggcagtcagtgtgcgtgaggctccaccctgcctgggctttggctcacctaaggcgaggagggtggtgaactggggtgccccactgggccgggtctgggagccctcagcgccagggtgcagaggccgcagccactccccttctagggtctgggcggtgggggcatgagaaggcggagacccaggccacttcacccagtaactgtcctcagctgtgcgcttaactggcgagatctccgctctacttggagacagtctggggtgtctggagaatcctcccccacttctgcttaccccaggtcgctgtgggagcaggtgtctcaggaaatggggcctgggtcccacccaaggcctcgggtctgagttagatgtctgtatgtttgttgttgcccctgcaacaaagtaccacagattgagtagtttaagccacatgcatgttatctcacagttcggggggtcgggaatctaaactgggttggcagggcctgtgccttctggaggcaagggagctgtttcccagcgtttccagctcctagaggctgctagctagtggccctttcctttgtcttcaaagccggcagcacagccttttctaacctctcccactccaggtcatttcacatcaactctttctgcctccctcttgtaagtgtgataccctaccttgttttaacctgaattgactgtcccttagctgagagagccagacacactccattttggctccttcacttgcagccccttacccaccccccttcctcaaggacttaacttgtgcaagctgactcccagcacatcaaagaatgcaattaatggataagatactgtggcaagctatatccgcagttcccaggaatttgcccagttgatagtaccctaagcccccacatttgtgtccggttgatggtacccaaagcccccgcatctatcgccttgtgatggatttaaaacccctgcacctggaactgtttgttttcctgtaaccatttgtcttttaactttttgcctgttttgcttctgtaagagtgcttcagctaggctcctcctcccctttctaaaccaaagtataaaagaaaatctagccctttcttcagggccgagagaattttgagcactagccgtctctcggttgccggctaataaaggacttctgaattcatctcagagtgtggcgtttctctataagaggctcatcagataatccaggataaccaccacccccatctcaagatcattaacttaatcacacctgcaaagccccttttgctatgtagtcacggggttggggatgaggacttgatatctctaggaccattgtgtggaccatgttgtccatgcagtaccctgggaggggtggcttacatttccccttcctctgtctagagttcagtgtgcctcaacactggactcaggcagctagcaaggctcaggggacccctacatggaacccgtcagctatcttgaccccttcccccagctgccatgcacccccacctgaccaccccaatggggcatggcatccacaccagctgcctccatgattgcgcccgagctgtactcaggctgttctgggggtggagttgggtagtgggatgttttttgaaaagggaatcccttctggcacttcctgagtgccaggcccagagctgccatctctcgacccccatgctgtgcttttccaaagtccccatctttctctgtgtcaccaagtcctgacagctgttcctcctctgtccatctctatcatggcaaaaaaccttgcccagccctccatcacctctcatctggagctctgcatgggcctcctctcagctcttcagattccatgctgcacccactccccttcccagctgttgtcttccaggctcccctcccattctcatcccccccaccacccatctctatgcagtgcttgtgcccagactgatgcagctacttccacggctctgcgtatgcactgggctctcccaccatgctgctctctccctgtctgaaatactcaatgcccctcccaccctccttctccactgctcatgtttcaagatgaacccccagcatcttgccttctgtgaaacccttcatcatcccctccttgtcctcatggtccttgcagctaccatgccgaatatgggactctgtgcctgagactgctgcctcactcttcctggcagccgagggcctccatgaaggcagggggccgtgtcttattcagcttggcatcgccactatccacctccagggctgaggctgtgctgaatggcagatgaagggctcttgccattgggatgagctgccccagcttctgcccacattgtccatgcatcatacacatcctgggctcacaatttagggcccaacaggagctccctgccctggtcctgcagaccagcttctggggtctgcaaaatcacgttgtcagctctatctgcaaaatccttacactgccagccagcccactgagttttgagtcaatcttcctccacgggaagataaaagcaggtggcaggagggagctcatccttcttgctgctcctgatgttctgagcattgagatgcaggcctgatgtacacgatcccatggagccctgcctcatgtctgccctgcagggtcatgacctcctcctcagatgaggaaactgaatcaaagaggtttcctggcccacccactaagtggtggatctaggcctggcacctggctccctcgttccttcttcaccagtgagcagctgtagggcaaggacccaggagaccctctcctgtggcgctgaccgtgaatcaggcaaagagccacaggcactttgggcagcctcccctccatccactgcccgggggctctgagacctggctggcctggagccagctccccagaacagaaaggcatccagggtctggcagcagctctggctctgcttcctgttttcagaccttgttcttccccgtgtctgtggagctgggaagcctggaaacagcagcagacatgggttctgtctttcatggccaagcggaagttttatttccatggcaaaagcacttccaaggagggctgcaggaagtccaagagtttaaagacctgcaaatgcctgcaggtgattaataattcattgcagcagatgattacgagaaaggccactttcaattaaccttaagaatcatccctgtctaaggaagtgtcatctctcatcactgaggaacacagaggccatagcaggataaaggccacgctgagaagcatgtggaagactgtgtttctcaattcatgcaaattgcaccaggtcagcccaggtccttctttgtgaggagggggagggttcccctgccagcatcctgtctgctctttggttctgctatggcggcctcagacttaatttcctccagccccttcttttgaggagcttggagggagtatctttccttgttggatcagaacttctcgtcccccactgaaacatgctggctccaaattgtgtctcctcctgcagacagtcactccgactggcagggtgggcttgggcctgtggctcgctcctgcccctgggcgtggtttctgcttcctgccctgctgctcccctgcctggcaggcctgctcccctgcctcctctcaaccagcaccagaactctgccttccctctggagggaacaacttccttccccttccctgtccacacagtacctggcactcccctactcacccctattctagcgctttgtccatgacccaggcctggctgctcagcctagttcatttctggctgcagtgataggttcagggatgtccctgtgaccccaccccctgcccccgcgagaggctaatcaggatcaacactggaattttgtgggatgtactggggaagagacacctcctttctggcaggagttgttgagcagaaggagctaagtctggggccatggaaagccccacgtggaggagccagagaggatggagccagcacaggtgctgaggtggggacctatgttgtcctggcagcccctgcatcctgctgcatgcagcccctgcccctggaggggtggagagagagggcggcagaggggagtgagcccgccaaggccactgtgttagcaaggagctgagccggcgttggcatcagctgttccagcttcagtctcttgaccaccaaggctgcccctcagcatggagcagaagtcaggaactgaggcaaggcttgtccttcctcaatcgtcacctctgggcactcagctgtcctaaagttttttgaccccccttagggatggggtcttttcagcaagggccatttgtggcaaacaacaattaatttactgctcagcctccatggctcactcctgcccctccgccagcttctgtgctaacaactgacccacatttttttttttcaggaacagcaatgtgctcagtcaccaggcatgcatccaatgagccataagagggcggaaagactttgttttttgatgtattaatatgctaaattgatgtgtcggttaagacatgaagaaattagctatcaaactccaaagagtggtgacagactaagacgcagatttccaaaggtggctgagaacctgctggacaactgtcccccagtgagaggaagggctgagagagtgagggagggaggggatttgccagattcctttcttgagggctggggctgtgatgtggactcccacctcctacggctggccagggctggggaggggggtgtgctcggggagggggctgtgctcaggtagagagggggcaggtggagcagaggacagcctcccctccagcccagagagttggggattcaactctgctctgagagcttgctttctgtcccctggagtttgggaggcagacggactgctggtggaggtgcacaggcaattgtggcttcttggttctgatgaagacagtaggcagctgctgtgttgggaagcagccaggctccctcagatgccagccaaaggtttgtggatcttgggcacatgacacgccactggtagtgcgagtgtggctcagagtgtgatggggaattgtcactgacatgtgcctggggacttgtcaggatgtggaatgtgtacatatttcccacaaccagacattggccatgtgaatgaaagagccggtgtgtgatcatctcagtcctgaccacaggccctacccagagggcatatgtagcacagtggaaggaagtaggaggtgaactttctaggggtagaggagggagcaagtggcttctgattcatttgctcaggtcaagggcactctggttctggagtgggtgtcaggggtgaaggatcgagggttcctttcaaagggcccatttgagcatgaaacctcttccagatctggagaggtaaggcatcttacgagaccgtcaagacagaactttccaaatccccttcccttcctctgctcatgctcttacctcagaagtctgctacgggcagtgagagaggagagaggaggctgaccatggcaccctctccaagggcagaggctgtctgtggctggccctcaccatgggagatggggagacttaactcaagtttgcagatttgattattacctaggtggcctttctgatgactgtcttgggactgcggggacagtggctagaagggaatgatctctgctgaatacctgctccttccaagtgtggcctccatagggagctcggggctctcacatgtcctcctttgttccctcaaatagatcccaagatcttgaacgagaccattttactgggctttagtgctcaaggctgaggtttcacttccataaaaaaatcagttaaaagtgctgagcctgtgggaaggctgttctttggttaccttctgtggtcaattaaacgattggtctcaagttctctcttccctgtactggtattgtactcccacagccttgcaacatggtgggtgcattagactgtttatattgcttataaaggaattcctgagactgggtaatttataaagaaaagaggtttaattggcttacagttctgcaggctgtaaaggaagcatggtgccagcatctgcttctggtgaggcctcaggaagcttctactcatggcagaaggtggaaggggagcaagtgtgtcaagtggcaagaaagggaacaagaaaagggatgcccacttttttaaactaccagatcttgcctgaactcagagcaataactcactcattactaaaaggaggcaccaagccattcatgagggatctgctcccatgatccaaatacctcccaccaggccccacctgcaacattggaagccacatttcaacatgagatttggaggggaaaaaacttccaaaccatatcagtgggacacatgcttccccatgatttgactttgagcatggccacatgacctgcttgggccactggaaagttggcagagatgatgcggcagaggctggaactgcaccgtgcggctggccttgctctcctgtgctttagccaaggcggtgagatgagcatggcccagggagagctggctccaggccaatgagtgctctgtggtgcaggtccaaaccccacctggagcctgagatcaaggagttcagcctgagccagcagaccccagccaacccacagacatggaagggaaaaataaatgcttctggatgatgccatagagactctgtaagcagcaaaagctgagcaaaacactgtcactctcttttgattcctttggtgagactagagctgtgagctggcagggccacaccccttgtcccctctccacatgcctcaaagttgtggctgaaggtggatgatcttgtcacttttccttactggctggccttggtcttctctggaccagcctctgctgctgtgggaggaataaagtgctaaggggtagtgggtttaggggaaagagagaaggcttgtgggggacatctgaggttttcacacagcatactttatccttcttttgttgcagtggtgccccagtcaaaagtgccctctgggaaagcccttccctcctcttgggtgtggttgactccaccctcttcttcttccagctgggcttgattcctccacaggtccctcctcctggctgcagagattggttcagggaaacacagagccaatgagctgcaaggctgatttttctgacaatgctggacagaggcaagggttcttcccgagggtcttgaatttaatgagagaatctcaaatgatgagaaaaaagctggtctgaggacagggtcagctgaataggtcgtacccagagaaagagagggagagagatactggatgctggtgatgggtgaatgagacaaggcatgaagctagaacaccacctggtttttcacttaggtgagcccacaaattccgatgtgtacttaatgccagcttgagtaggtatctgccatttgcaatcacaagtcttcaatgatacaagattgcccacctgctttgggccgtctgtggcccaaatttgtacctggccttattttagggacatacacctttcttgggtttgcacacacacatgtgtgtttacatttggacatagtagaacaaaataatttatataaggattttgaaatgctgaccaaataaataatctacaccaaatactttacttacgttgttttattcattcattctttttaaaaaattatttattctttacaaccaccatctatggcaggtttttttttttgttgttgttgttgttagatggagtttcgctcttgttgcccgggctggagtgcaatggcacgatctcagctcactgcaacctctgcctcccaggttcaagagattttcttgcctcagcctcctgagtagctgcgattacaggtgcccaccaccatgcctggctaatttttgtatttttagtagagatgtggttttaccatgttggccaggctgatcttgaactcctgacctcaggtgatctgcctgcctcggcctcccaagtgctgggattacaggcataagccaccatgcctggcctatggcaggtacttttatcacttaggaaatcttttggttacaatttacagtaaatctgactaaatctgactaaataagcctaaatagggcttacaccataagaagatttgctttcttatttcattagctctaagatgtcattgattgtgaaatgcaccactgttttgcaccactttctttgtataagcaaaacttgctgccaaaccatgaagccattctttactatcaaatcagatatgagaagtgacagtggtgtcagaatgtgaaaaaaaaaaggccttccttggaatggggagaaatggtgttacttagcaagacatttgtggttgggtagcctcagatttgacttggcagctcaacatcatcatctaagatccaggttccttggatgtgtcacctgctctgccaccttcaagtttcgagatggcttggtgtcttctaacaccaagttcaaaggcaggaaaagaaggaaaggaatctgatagggaaagtgtttatttcctcactcacatccctcatcttatcagaaagcctccggcacactgaccctccataccttgttgctcactggcgagacccacacacagccatgctggtttcaaggagaccaagaaagtgagtatctgaccttttcagtcctataatgggagactggttgaaggaagaggacataagaaatggctgtcaatgccacgggatttcaattccaattttacagatgagaaaactaaagctggaagaggttcggcaactcgcccaaggtcacacaactagaaatcggtcaaccccagatttgaatccagtgtcgaatgattcaaagttcttcccattgcaccataaatcatctgtacatgaaagaccgaagactgagaaacctcaaatacagagcaggtaaatagtaaggaacgtgtttggatgaaataccagaacacctgaccatcagtggatcagataggggtttattgttgttatgtagccagcaccccagagatcagcagcccagggtggcacagatgcttaagggtttcatcaagatcccaggctccctcatcatcctccttcaccttctggagtgtgtggtttctgtccttaagttcacagtatggctgctgcgtctcaaggcatcacatctagctttccaagaaacccctacctagtgattccctcttacatctcattggttagaacaaggtcacgtgtaactaaccccagatacaaggaagttacaaggaaaagtaaatatatttagctagacaattgtcatcccagtcaaaactggtgctctgttttggaagaagaggagagagaaattgggtagtggttgtcattagtgaagtgggtatttggccactatatttggttttctttcttctaggcagatggtacaacccttggggttagttaaggatgtgtaacttactttgatcaatgaaatgggagcagaagtgagatgtatcactttctagtggaagctttaaaagttggtgcataaaaagacacatgcacccatatgttcatcactgcgctattcatggtagcaaagacatggaatcaacccaggtgcccatcaatagtgggttggatagaaagaatgttgtgcatatacatcatggactactacacagccacaaaaagaaggaagacctgtcctttgcagcaatatggatgcagctagaaaccattatcctaagtgacttaacataggaacagaaaactatatactgcatgttctcacttgttaaatgagagctaaacattgggtacacatggtcataaaaatgggaacaacagacactggggaatacaagagaagagagggagggaggggggtcaagagtcgattaaaaactgcctattgtgtactatgctcctcttgagtgatggattcatttgtcctccaaacctcagcctcaaaatatacttttgtaacaacctgcacatgtaccctctgattctgaaataaaagtttaaaaaaagacagttggtacattgttccccaagttcttttccattgatgtgatgactgtaaaagcaaatgccaagagtcctccacgatgaacagagccctcttgccaaacctgtgataggcatagagcaagggtgggaaatagacttgtgtttagttaatccactgctatttttgtgaggtcgctattgcaacataacccagactatcctgacacaggtcggcaatcagcagtgtccacacatagtcctcaagcaaggtcatgatcagaccagggaggagccagggcctaagcctgaactggcataaacagtgccccaatttctccaaagtgaggactgtgccagtgggcctcaagacaagaattgggagtccacagctcccagacactggggaccccctcctatctggagctgcctggctgccacatatgagcctggtgacccagccacacccaccagctagctcatcagcagtgtccatgtcattatcgaggcagagaaatccactcagcgaggatttcccacgttagcccagcatccttacttctcgctcatagtaacagaaaccatgttcccgcctccaacagatgcactgtgctctgcactcccctggtcagcgggtgggtgcatgatgcaaactgggccagtcagatgctttcattctgaaacttgaatcttgagtgaaataagccagactcattggggactgattggaatttactcaccccggtggaggcacatggaagaggcccgttgggtcctgctatctatgtcctcagagcttcacttaccacagttcggagaggacagcacatcctccaggggttctgaacctgaatgcagcaactggttgagaacctgagttctgcgctgtcttctgttgcagtgggagtgagtagggttttggtggtatatggtataactgccttatcttgagaaagaatattttaacagctgtgtttatgtcaagaggggtatgtgtaacattcaacaaccaatgctgcagattgcagaggacatttgttgtttttgcctgctcagcatctattcttgctgcttctggtgacaaaattcagtggtcccatttctcttttaactccagagctagatttgatccagacctggccagtcagagcatcacatgctgcaggcctcagtgagtggttaggagctgggcagtggcctaccttagtttactatgacttgaacctggaatttgtgggcaacttttgggagccataataacagtaatggcagctgggctcacacctgtaatcccagcagtttgggaggccgaggtgggcagatcttttgaggtcaagagtttgagaccagcctggccaacatggtgaaaccctgtctctactaaaaatacaaaaatcagccaggcgtgatggtgggggcctgtaatcccagctactcaggaggctgaggcaggagaatcacttgaacctgggaggcagaggttgcagtgagccgagattgcgccactgcactccagcctgggcaatagagcgagcctcagtctcaaaaacaaaacaaaacaaaacaaaacaaaacagtaatggctagtacagttaacttggcactgtccttgttccttaaactcttgtccatggacttagagctgtgaggacataaacataatccaggagttcccaagacccactatgtagggagagcctggctaaaagagagaggtgccagttctgatgacatcatttaagctaggggctctggccaagcccggttaccctggactgttgacttacaagaaacagtgaaaagtccctttggtgcttaagccaatttgagttgggtttctgcctcttgaagtcagaagagtattgcctaatacaataattctgtgtaggcatacaagacacatcagtggtggtacctgccatgcccgcagccctagaggaggagacagccagcaggtggccctattttagatcatgtaacagttggacaagagcaagcaaacacctgactcaggctctgaatcaggctggtcaggatttgtgagttttcctctggcattaaagatgacctatgtctatccaatttctcttttttaaattggaagttgagaaacagggcaggagcgagacagccagctgcaagggaagaagcatgaaggatatgtgaagaggtgccactaggaggagctggcgtggtggcaactcagtttcaaagcagcagaaattcagcatcaggagagggcgccagttggtggaaagagctggcagagcacagtcaggaggaaacctgtctaggaagctccatgaagagagggagcaatggctatttctgaagttgtctcgcctattcctgaggacttttcaattctggttcaaatcctcatgcatccttataacaaacccattttttcccccaaacaagttgcaggtggtctgagaccaaagcagacatcccccttccatgttgcctctgtaaccctcccacggtgaccagcgtatcactaaggacacttttggtagcaaaggatggaaatataatgcaaattggtttttaaaaaaggaaatgtattgtcttccttaattgagatgtcaagggatgagactagccttagtcctcactgaggtcaaggctcccgggatgttctcgggaacttgcttctgcacatcctcactttgtccttctctgggcggctccagtatccggcttcatgtaagatggtggcttcatcgccacattcccttggggaatagaatgagtttctttctccagattcccagataaagtatttatcattggatctaagtggggtacacacttatcctgaacaatctctggccaggaaactgatacagtgattggctgaggcctagcatacacccctcctctaagacccacatgagcgtagaggaggtagagtgtgagtaatatctttgtggaatatatgttgaactgctggaagagagacttcaaataagattggcttaagcaagatagaagtttctttctccctcacctgcctgcaggtaagcagcctgggagcccaggtttttttttccccatcttgttgcttctctatccctaggtattgtgatgtgagatgtttcaccatcacctccactgcctagccagtggaaacggaaaaggcggaagaggagggctcgcccctctggttaaaagtgtcacctctccctacttcaatgctgctggtcagttacttggccaaatatagcttctaggaagtgaggaaatacagtattttttttctggatttccgtatctccagataaaaaacaagaattctttaaacataggagatgagtgtgatcgggggcaattagcaatctcagccccagcctgtcccattggccagtcaaatttccatgtgtcccctccccaggggagacaaccctaaagttgcatccagtgcctatgtccagctccaagcctgggacctgtggagggacagcctgcaccatcagatctgatgtggtttttgttttatttttgtttttttagacaagttctcactatgttgcccaggctggtctcgaactcccgggctcaagcaatcctcccatcttggcctcccgaagtgctgggtttacaggtgtgagccaccacaccaggcttctggatgcagttctttatggtgtgttgccccggaacccttacatacattgcctgcctccttacacccaatatgcaacagccagtaaaaataagataaacatggtgggaaacctcatccagaagagggaaaaacacacccaccaaatcctggtgggcagaaattgtgaaggctcccagggagtggagcagagtccttggatgacagcgcctctctccaggagtattccctgggatagacatctttggaccttggtggtcccctctttgtccactgccttccatggcacaactaaagggcatcaaacggtgtatccctcttagggctatacagcttaaacatttttttttagagagaaggtcttgctgtgttgcccaggctggactcgagtgcctggggctcaggcaatcctcccacttcagccttcagagcagcagggactacaggcacatgccaccacactgggcctgggctgcatagcttttgcagcccactttttgcaggtgcaggtttggtgggtaggggtcggttgatttaaggagtcaaaaatgcagacttgtaccagccagactcatggttctttggtaacacatgccccttaaaatctcagttggctttctgcctatttgtggctagttatcctctggggcaagtacaggttgggtatcccttatctgaaatgctcggggccagagtgtttcatatttcagattttggaatatttgcattatcctggctgaacatccctaatctgaaaatccaaaatctgaaatgctccaatgagcatcatgtgtgctcaagaagttttggattttagagcattttggatttctgggtttttggtttagtgatgctcaacctcctttagattagcagtatttaagcctaaaaatggtggccttttatttatcagcctgtatgttatatctattcacctccctctcaacctgagaccagcgaaaacactcaacttggactggaaggcagcttccttgatctggtctttgtggccgagcggctgtcattgtcaggttgagaaacgtaatcaagtgtttgagaaagactagggtccatagtctcgtctcctgctaatcctgcttcttcagaaaattattctatatctgcctcagtttgtggtacagaagcaatagatttttctctttatttttttaaataaatataattttattctaaaggaatattattatatggcaacactttgagaaccataaaggtgcctttgaaatgttgttagaaaatcacttaaatcatattttttattaataaattgatgccattttcaggcacagtatttttttgggcaagcactgtacagcataattcaaaatatacccatttacagaatccaattaggtatttttctgctcacaattatatgatggctgatttctgctcacaattatatgatggcggatttctgcctacattatgatgtgatatgatatgatatgatatgatatgatatgatatgatatgatggctgatttctgcctacattatgatatataactgctctacagaacatgaaacagaatttcataacatcagttatatttacactctactttaaaaatctttcaagatataagaatcaagctatcaaatatggagtttttaacaagcaatagtttttttttttaggtctgaaaactttttaaactgaggttatagcccataggcaaagggagcttctttcagcactgctgtattctcttcagtatctgccttcctcgggctagctctgtccacgttcttctgggtcatgtaggactctgttgagagtggcaagaagcatccagcaaacacctgcattctgaaatttccaactgtttcctttagagcaagagctgactttgcaaggtattgcaggaatcagttgatcgactgctatggcatggcataaacagggtttccagatcatcatatttatgtatagcatttaaaatatgttttcagttttgttaccagcaacacagcccttcttggtaataattagtatacagcctttactaataattagtatacagcactaataattagtatacaggctttccttctgcaagagagcactcaccccaaatagtgactgaaatagactggaggttaatttctctttcatggaaaacctagttagagctagtccagggctgataggcaaccacagtgtgttgggacacaggctccttctcttttgtcactctgacatccttagggttttagcttcatctgattgatataaactggcttcacaccatgacttcattcctaccaggggagagggaaaggggcgaggcacatttcttctgaagtgcatgaccgagaaattgcaaaaattacttctgctaacatctcactgctgagaacctaatctacagcatgttgggtgcacgatgcctgggaaatgtggtcattattctgggcagttatgtactcagttagaggaattctattactatagaaggggacaataagtattgggggacaattagcagtctctgtctcgggatgatcccccaaatgaaatgggggctggattgtggggagctgaaaaagcaacagatgtctactacaatgcctctcctctgagcactccagccccttctattcccttcaatccttgtgacctaattgtcctttgggcatctgtctcaggtcccctgaatcccccatcatgtaggctttggggccaaggcacctctgatttagcctatattgtcagcttgcagctgataattattattagggactcaggaaaatgtctgtggaactaaattgaggtagtaataggcatttctgaatcaactgccttccattcattcattcattcatccagccagccagccagccagcaaacatctattatatgctaagtcccagggagtcagtgtctttttgtcagacaaaaagacagccttttcatttatggctcttttggctagaggggtctcttgtaccctagagatattttgctagaaaagcagatgctgtttaactgaatcaaagctctctcttccttaggcattgatacatcccaacttagcatttcctcaaagcttgcacagaggctgtccccagcggtaatttgtgctttgggacagctcagtatcaggttcccttagtctggcaacagtgtcttgccctttcctttggggaaccactcttcactagtctctgtgacccactgtcagccctactgcagggccccaccattttgggaagagcagtgacacaggctggtcaattgaagagctctctctctggtccaggattgtcaagtaggggcagtaagacttgatttgtgggttgtttagatccagagatgtgaggatgtagatttaaggttgccagcaactttctttcccaagaggagagagactacggtacctcagtactacccccatcatttcttcttgctctgctattacataaagaagtcacctctttcctcctattgaactcctgaatctcagcccattgaggaccttattgccagtagcaattctggctcctgtatctcctgtccactccttctcaatgggtacttctccctagcagtcaaatgtgctcagttcgttacaatgtgcagtggatacttgtttctggtcactcaggcttcaacctccctgctggggaaaactgtcttgtgagcagtctcggtggggcagtgggtgatcctagagaggcattgggccaggtattcctccaggtatgtcgatccaagggcagagggcatgtggccatagctcggccaaacaaactgccactccactgggattttgaatcttgagctgagagacacaccaaggaccatggacaggaatcctttctgtggaggtggcactggggagcaagtggttcctcctgttgggatctggagtcacctggctcctgccttgaagaacatggctgaaagcattagcatctggagatccctgcgatcttttgacatatccccttttgcttaactttttttttttttttttttttttttttttgagacagactcccgctctgttgctaagctgtagtgcagtggcacaatttctgctcactgcaaccgccacctctcggctacaagctatcctcctgcctcagccttgggaacagggggactacagaaacatgccaccctgcccagctaatttttttttttttttttttgagatagagtcttgctctgttgtctagactggagtgcaatggcggtgcgatcttgactcactgcaacctccgcctcccaagttcaagtgtcctgattctcttgtcttagcctctcaagtagctgagattacaggcagacgccaccatacccggctcattttttgtatttttagtagagatggggtttcaccatgttggccaggctggtcttgaactcctggtctcaagtgatccacctgccttggcctcccaaagtgctgggattacaggtgtgagccactgcgcctggccatccctttttgcttaacttaaccagacttgctttctgttgtttgaaataaaagaaacctactacaggatgcagataataaaacaagcaagcaaacaaaaaaaaatagcattaaaaaaatgcctctcttgaccctacattccttcccaagtgacacctttcttctcccctttatggctgtgtttaaaagaggcatctgcacatgcaccatctctggttctctcctccagctcatcccccaacccacgccagtggcttctgcctctgccacctcactgaaggagcttgctccaagtgccctgtgtcaccatgatgtcccagtttcccactatcttttctgggtgctcctccatcctttgtcacctggtgactcacaaatgggtcctaagccctctcctcactctactctttccctgaagaccttatccacccctgtgacttcagcaaccaccccatgtccatgacacccagacttctgaaaaactccggtccttggctgggcatggtggttcacgcctgtagtcccagcatcttgggaggcagagggggcggatcacctgagatcaggagttcgagacctggccaacatggtgaaaccccacctctagcaaaaatacaaaaattagctgggcatggtgatgggcacctgtaatcccagctattcaagaggctgaggcggaagaatctcttgaacccgggaggcggaggttgcagtgagtcgagatcacgctattgcactctagcctgggtgacaagagtgaaattccatctcaaggaacaaaaacaaacagaaaaacccctccaatcctgtaatgtgcaacccacctgtccacgtggtgcctcaaacatcccagtgtgcccccgctggacccctgagtgcaccccacactcattcctcttctgtcagggttcagagtctcagcaaatggtagttggcccatgtggtcctcaggcctgagctgctctctaccaaagcaatctacacatatccatcccttccttcccccatgcagtgcagcttgtacctccaggacctgacccaggaggagctcagtaaatatttgatcaagtgactgatagcagcgataacactccacgggacacgttcacaaacaccctcttcccccagccctgttaggtaggtataattactaccactctgcagatgaggaaactgatgcccagagagatgaacagttttgcttgggtgtggggttgcacagccagtgaatatgtgggggagttgagattggaatttaagtgtgactccccatgctgggttctccctggacagctgccacagccaggggagcctccttgccagggcatgaatggaagaagggggccagttggacaaggagtgatgccctggggtgagggccagccagctgtgttcacaggtagattgcatggcagacatctcctgacacccagccccaagaaggcttccttgaaacacacagtgaggttcttggttcttgagatgtcctgggagctgagagccccaggtttggggcctggatctggcaccaactctcagtgtaaccacaagcagtccatcccttcttggggctcagctgacttcactaaagagggaatatgagtaagatgcctaagatgtggaagcagaggtcctaattcctggacaggggcagaagtgggtagtggcctcggcaaacaaatcccctatttgcctcctttaagcaggatccccctaccaggcagtgtgtgatggtgaggcccaagcctggggtctgacgtcgacacccctgtgggcatttggccaaaggcagccatctgccagaatctgagagctgctctcagacctcgctggagagggctacctggggcagtctgagtctctctgggcagactgaggtcctttgctacccaaacggggagaattagagatactgttggctcctgggcactggaagggaggaacgcaggcctctcagcacagggctgggccaacaagttgggggtcccggcacaggggacaacggagaagtgccaacattgggacccaattatgtgatactggggcccagagatagtacaggtgcctcataccacgtggccctgggtggacagcaggaatctattgcgagtggcgggaggccggggctgcctgtcctgcgccctgaagctggccagcggttgtggaaactgggggatattgagggaaccgtaggcccaggtcctcagcctcatagtgtggaacctggcgatcccagggcctgggctggcccccggcgtcacgggaccgggaaggcgctgtggtgctgcggggaattgcggagaagaaggcgggctccagtggaggtggctcatccccgcacggtcactgccctcgcccgctgttggggtccgcggctgggagactgaaggcctcaagtcgggctgggtaggggcacgtgggcagggaaaggggtggtagattaccagtcttcaggggcggggctggagatgcaaccctagggaaggagtctaccaggctgggctcttgaggggcaatggagggctccgggggccaggccaggccaggatcatggagttcaaaggactggagtgaggtttggggtccatgagagtggagctcagaggatgggacggtgggtccaggatttgggacctggggctggaaagtccgaggctagtggagaccaggcctggtatcccagacgaaagggccctataggaaacggggtctcgtgggcgggatctggagccagagaattgtgagaggcggagctaggatggagaaggcgagaggaaaggggtagccgccggcgcggagacctcaatgcggggcgtggtgcggagggggaactggagcgaggggcactggagcgagggggtggggctacgaggaggtggacttgaggggctgggtctggggccggagaatcgtggggagctgcgcctatacacccgggacggtggggttgcgtcggggaagtgggagtcttgggggttcgctgggcagcctggagaacaggcggtcgtggtgcgggcggggccgaaaagaccgaggacagtggggacccggcctgaggaggggtcgggaaggaggggtgggggcgcgcggacgcagatcccgggccgcggcggggcggtggcaggctccagagtggcacgggcccaggtgagcgaggtctccgcccgccgcccctcccgccgccccggtgccagctgccccgctggcccctccctgtacccggcgcttgctccgcgggccgggccgacggcggcgggcggcgtctcgcgcccaggccaggtcggctctggctccatcttgggccgcggcacctggcacctgtggcggccgcaggagcagcgcttcccccgcctgcgcggccccggcgggcgagagggtgagaggctggctccgcgcgctcccgttggggcggggggcgtggtgggcggcacctcccccttgctgagcctcagaacccactccttcccgctgcctgcgctcagacccccggcatcctggcccctgcccagcgcccagagcccccggtggccgcatcgcactccccgcgctccgcctctcattgtcctgtcctgtcccctcttctacgtctcctctgcccatcctcccattttcacaagtctgtccgggaccctgtctccttcggcctccacccctgctgccatcgctcctccctctccccttcttccttttcccctccctcagcctactgcgccgcctaccccgcccccagccttgctgccctttggcttctcctgtcccgcatcattaccccggcccacagccccatttgcctgcagtcgctgcctttgctcctgagaaggtctgtagcctcgtttcgggcccgtattgagcccccttctccctaagtccgggtgggctttgtgcaggaggggcgggaggggagctattctgggcgaggctgcgtggtgcggtgctttcaggcctttggccccgcagcaggggcggcctgtgcttggcgtgcagagtgcagctgggtagacgctgttactgcatacgggcctgtgtgtcccaggctggggcatgagtgcttgtgagcgtgcagatagggacacaccggccgcctaggctgcttctaggccggggcaccctctccacctaggtgccccccagggattgtgggcaaatcctccccaggggaggaagctcaggggctgttgggcgcctaggcctcttcctggtgagcagagcctcatccatggggccactgaccccacagttaccccagaaccctttcctggcacagcttgtgacccggggcatgtagcccttaaggcacgttcattgtgaagggcaggttttgtctcctccaaaccctccctttaggaatgctgcctgctgctttgcccagagttggccctgagtgttcctatcaggccccgttcactctggggtggattaaaccacctcctggagggtgctgtatccccactgtgcaatgggggtttgtgctgtgtgcattcctgcctggtccttgagaggtaaggtccatattttaacatagaaccagttttcctgcctgatcatataggtttgcttttcctgttttggttttgccggacacataagtcatcatccaaatgcttgccacttaactagaggggacttgggccaggcgctgtggctcatgcctgtaatcccagcactttgggaggccgaggcaggtggatcacctaaggtcaggagttcgagaccagcctggccaacatggcgaaaaccccatctctactaaaaatacaaaaattagctgggcgccgaggtgcacgcctgtaatcccagctgccgggagactaagacaagagaatcacgtgaacccaggaggcagaggttgcagtgagccgagactgagccattgtactcgagcctgggagacagagcgagactctgtctcacaaacaaacgaacgaacaaaaccaagaggggacttagatggatgccacagtgttgtctgagatggagcccacttgtggtggtcttggtagtcccctgggcatatcccaaaggcctgggctcctctgctgtggcagcatggcgggagctggactctgtacgttgactcaaaggtctctatgtttgggctagtctggaagtgtctgagaactgggggcttttactcaaaatgacattggttgattgctacataggtggttgatcttccagttgctgacaggtggaacctgaggcagcaggacagcctggcattggccacgggacatcggccacaaccatagcaacttcggcatcaaatggggcaggagagagaacattaaggtatcgttcaaagaatactagaggtcttggatacttctgtatgcctgttctttatcttgtcctaaaagatcttccgagggtccctttagggcaaaaccagaaccttctgtgttgttataaaggcagggtgggtgtgccattctgggcatttaaagtgcagactctagacttgtatgcatgcgtagcctcctaggttaacatttaaaataggctctgggaaacctagtttggtgatagggagactggggacactgatggtgacctggtcctaggatgggatgaaggtagcgaggatgggaagctagaggaggctaacctttggggtgtcttgatggcttctgaaaagggcctctctggcccccagtactaatacttgttataccatgaacttaagctgctcttgatgggaggggaaagagaagattattgttaacaaacactattgcagacagtgcacatgctgtcacatttggtcttcacaacaaccctgcagggtggggatttatttctgttttgcagattgaagaaactgaggctcaaagaagttaggggtccacctgtgagtacatgcacaggaaggggaagagcccccattggaagcagagccctgccccttcctcctcacccctggctccctgggaggcccctcctctggcccagtccacagcactgtgacaggcagtgtggaagcctctttcccccagtactcccctcagagcccttccttccttctgagctgggaaggccaggttgtagttagccaggccaatccattggggttctgaattagccactttcagctgtgtgttctttgacatttctgagctgctccaggcctcagttttgtcacctgccacttgtggagggggaatggggaagggaaccaatagatacatagcccacacgggggtctctgggtgatgactagccctgggtgctgggcagccctctggtgagacaggcacagtgggatgctcattgctcatggcttctcagtgggtcttggtgggggtctgaggacctcattccacctgtctcctcaggggccagaggctgctggcctggctgtttatggcccccctccctgggagggtggtggggtttggccagaggctgtgtggatgtccagatggggcctccctggggtcttggacctgcaactgagtggttgtctccctgccaggggctggcagtgaccacagctgtcccagtcaggaggaacacctcctgccctcctcattcttgcagcctcaggagctgctaagaagcatgttgggcaggtggagatccactcagtgacttgttccatggcatgtcatgagcacgattggcagggccaggccagatcagtaaaaagggtgagagctgcgaggcataggcctgctcagtgctcgaaggggagaggagctcagctgccccacaggtgtgtgcccttgggggtcactgagcctctctgagcttatggaattctcctgtctgtagaatggagataatgactgtctcaagaggttgcttgcacagttatatgagacaatgtatgcaaaggatgtggcacgtgtctggcccttggcgagtgatcaggccctggcagctgttattatcatcgctgttacgggctttattgccctcctttgtttgtatgtccatcttagagctcattgagggcagggtctgggtcagatttctctcttggctactcctcctcttcctgatcctcccagggacaagtctggcttcagccccgtgaagcagctgggatgggacatccttaccaggccggggctgtgttcagagctgcacagtcctgtacggtagccattagcctcatgtggccagttagattcaaataaaacttaaacattcagtgtctcagttgcagtagccccctgctgagtgcttggtacccacatgccattggtgcctacctattggacagcacagggtagaatctttccatcatcgcaggaagttgtgcagagctggagtctcagggactacagcaccagtatcatcctcactgtggctcagcagccaccagccatctcctgagtgctgggctgccaggacatttgtaattacacagaaaccgagtcccacagcccttcccgaatttcctctcgggtagccttgctcacctggtcggggaggttgttgcctggaagtctttatcagcctaggctgggagggcagggctgggattgcccaaatgcagctgctgcctcctgtccccaccctgtttctcccacctctcctgcctggcaaggagtcccagagtgatctccctaattcactgctgtggccagggccgaggtggcccagacactttgaccccactgctcccctcatatgctctggacacatggcctctttcctcctgcccactccgctctccacctgaacaccttcttgcttctctcactccaggcctgacttacgtggctggtcctccaggaagccttttctcatctctcaccctccgtgagctctcctgccttggtggtgccctccctcagaccccatttttggcactcagtgccctcctctgtgggtgtgttcttgtatttgcttgttctcttggtcaggcacacagcagataatcctctgagtgccgacgacacatcaggtcagtgctgggtgttggacagccagaggggagcaggccacaggccaggctttgccaacttcaggcctgtggggaggctgacagttggccaaactgttccatgcaggcccaatgctcagtcagggatgaaggctgcctggctggagggtcgggaaaggggccccaggaagagatgcagaagtggaaagggccagaactggctctaggctgcagctgccaggtccagggtggtctttatggctgggggaagtgacagcgatggtacggagggtgggggacaatgaggatgcaggtacactgggcaagaggggattaaatgtcaggcaggataggtctgattgatggtactgggtgggcatcttatctcactgctgcaccgtccccaggggtacagaaaggtctgaatgaatcccatgttccctagccctacagctgggcacgcagtaggggctcaggagatgctgtggaatcaatgaccagatgctgaatgagtccctcatggaaaaagctgatgcatggggcctctccttgcccctggagctagaggtaggagtcagggaaccccagagacatgccagctcagcaaggctaggccaaggaggatgggggtggttgtggaagcccagggtgattctcagtgtcctctggtcattgctccctcgtcctgtgaactttctctgagctcccactctgtaccaaggagaccctgtccacagtgagttggatactgccagtcccaggaggaagtagcccagtattggcctgtccagctgtgcccgttaagaggccatagtgcttccgtgctggttgaccaagagctgttatcccacagccccaccccctagggctgcagtttcacccccaaagccccagcagatttggctctctcccttcccctcccacacaaaccagccagtaaagagttgagagctgatagagtggcggcctccaggaccccaccctagggcagattctaactgcttgagactgatgatgagataatttgcagtgtcatccttgtgtctaatgtgagatgaccttgatttgaagtgtctggtgtcttgtcactcactgccttgcatatggttctgaccagtcaggcaggctgggactgaaggtggctccctggtgaacctagcactgtgggagttcatagtagaatcggcttaggtgctgccacccaactcaactccactccctccctttctctcttctgcaggcagccatgagctccagccgccccgagccgggtccctgggcacccctgagcccccgccttcagcccctgtcccagagctcttccagcctgctgggtgaaggccgggaacagaggccagagctccgcaagactgccagcagcaccgtgtggcaggcccagctgggcgaggccagcaccagaccccaggccccggaggaagaggggaacccgcctgagagcatgaagccagcacgggcctctggccccaaggcgcgacccagtgctggaggccactggtggagcagcactgtgggcaatgtgtccaccatgggcggcagtgacctgtgtcgcctgcgggcccctagtgctgctgctatgcagaggagccattcagacctggtccgtagcacccagatgcggggacacagtggtgctcggaaggccagtctcagctgctcagcccttggcagcagccctgtccacagggctcagctgcagccaggtggtacttctggccagggtggccaggcccctgcaggcctggaaagggacctggctcctgaggatgagacttctaactcagcctggatgctgggggcgagtcagttgtcagtgccaccactagacctgggggacacaactgcccacagcagcagtgcccaggctgagcccaaagctgctgaacagctggctaccaccacctgccatgctctgcccccagctgctctactctgtggcatgagggaggtgagggctggtggctgctgccatgccctacctgccacagggatcctggcctttcccaaactagtggcgtcagtgagcgagtctgggctgcaggctcagcatggggtgaagatccactgtaggttgtctggggggctccctgggcattcccattgctgtgcccacctttggggtcccgctgggttagtcccagagcctggctctaggaccaaagatgtgtggaccatgacctcagccaatgacttggcccctgcagaggcatccccgctgtcagcccaggatgctggtgtgcaggcggccccagtggcggcctgcaaggctgtggccaccagtccgtccctggaagcgcctgcagccctgcatgtgttcccagaggtaactctggggtccagcctggaggaggtgccgtcccctgtgcgggatgtgcgatgggatgctgagggcatgacatgggaggtgtacggagctgcggtggacctggaggtgctcggtgtggccatccagaagcacctggagatgcagtttgagcagctgcagcgggcgcccgccagcgaggacagcctgtctgtggagggccggagggggccactgcgggctgtcatgcagtccctgcggcgccccagctgctgcggctgctccggcgcggcccccgagtgaggagctgtggcccttggagctggcctgggcccactgacttagtcctagacctgggccagggacggtgggggctccgtgccccctggacccaccggcagctgggcacatctctcacctgaatattggctgcctccagaccacaggactgcagcctggggcttccggccctacacagctgggctgttttcttaagggcttgatttccaagggccacatctctgcaccttccgggctctgaactttgagacagggctttagcactgtgcagaggggagatcctgagttttctgtaaaaaatgaccttttgttcactccaccctcagaactctgccatgttgcctcgtcagactcttggtggctttatttgaaatcagtgctgagaaatagtgaattctcgacatgaaatgtgaggccccagtgacagggactgcccaggtctttagggaaggggactgatgttatcagaggcctcctgtgtgccacatactgtgcttgtcctgtcttcacctcttcatcctggcaagccttcatttggcaaggctgtagccgatgtgccccacgctggacagcttgaagaggtgggactgagatccaaagccagggccagctgagccgtgggtgttgccctgtagcatgtgcccggtccagtcagtgcagtcatgtatgaggagaatttactgagctcatactctgtgctgggttctgtggattctgtggtgaatgagacagaggctgcccctgccctggctgagctcatggtgtgggttggggatggcaggggaggatgctgaccattacggagggctgccaggcttccagggtcattgtgtcagaggctggcctgaggaaggggagaatgggtggccacctgccctaatctcagttacaaagcctaaaattgcactattttcacctcattctgtcggctgaaggatttctccccagctggtgcagtttgtggaaggagggagggcaggaatggagggggacagggcaggagtttgccctggccctggggtaggggctgtgaggctgtgggggctcgcttgcccacatgacctgacctaggctaggcagtgggggccaggggccttggagagacagaaacatgggctttggcacagtctgacttcattgcccaaagatttctcgaggcctgtgaagaatgggagtgggcttgtgttcttgtcctgggtctttgtcttgaagatcctaagatcccgtgacacagccccccaatccacccgtgtgagggaccagagggctagtgtggggtcatggcccacgacctggcctgtttctggagcctcttctgcacctaggagcccaggacccccacagtggtggcttacttttccccatcctcaaggacctggtactcattgaggtggaaatgactcatgcaacagttggtgaatttgtaaagcaggagtggcatttcaacaggccacaaggacaaagtgacaaaggcgtgcgtcaggtcagatgcctcctgaagcccaacgatggaccattctcacccgtaaacatgcctttcccatatgcataggtgcaccccttgggattctggggctgtcagtccctttgtgtatggtgccagggcaggcagctcacgttctggggagtgacacatgggtatatgccatcttcatgcctggctccccatggagtctccaggaaccccagcctgttagggccacatgagagagaacaaatggctgtgggtgcatggggagggacctttcacacagggccatagctaagtagggtcttgaggatgcaggggttagacaggtgggtggagagagggcaggacctgcctggcagatggaacagcctggtcagatacttggatgtgcctgtcctgcctgggccataatgagtttctgcagtggcggctcatttggagcgtttgttgggttgggaggtgaccaggggtccccattgtgaagatcctgatgtaaatgaggaaaggaactttaagggaactgtggaaggggttctgaggtgggaccagatttcagtttagaaatatccatttggcttccagtggagatgtgccaggtgacaccaaggaggggcctgtttaggggcaatggagtgggcagctgggggctgggttcatacacgtgcacacacacgcatacacaggcacacatgtgtgcaatggatttggggaggaggcatttcaggatgctgaggtttccagtttgagcaagaggagggtgaggccactacctgggtcaaggtgaatggcatgttcagcaggtgcagaaagggccacctgccacagggtttggctgggaccagtgaaacctacttcatgaagagactttcttctgtgtcacgtgcagattcttatgcattcacgctggctgggtgccactctgtgctacctccatgctgccctggcttgccaggatggcaggccgggctgggctcagccaagctcccactcacctcatcgtcactgagatgagtatttgcagagcggtgctgaaatccaacacctgtgtcttggctggggccccagatgattctcctggctaaaccacgatccttgtctccctagcccagttgcacagctgctgctgacaggtctacctgaagtgactgcagcctcatttctgattggaactggagacccctcccaaccccctttgctgtgccctctcctggaacagccctgatgcctgcagtggtttagggccccagagcatggccagcggtttagtttacagatctcctccccttggactctagatttctggccagactttctgggtccctttcaggccctgctctgggaggtgttggagttcactgttgatgtgtttgtttggctttgaattcaaaacagatacaaatttggaggtgagagctttgccagaccccagcagggatggggcatcggtcctgactggtcttgtttattttgtcctggtaaattctgttctttggagcataaaccctggagtcctagagccccttgcctcagcaggaatcccccctctgtctgctccaggggctccctgcttctgcccacctgctctccttccatggcattcaggacccccgacagctgaagcctctcttcatatagcttgtcccctctgggcctgcctgtcttgtgtccaggacacaagacacgcatcccttgtctggccccaggctgccatcactgtcacaagaaactcatagagtagagctggtctgaggtcacagtgctggtggtggtggaaaagcagggatggcctgttccactgtgatcttacctcctgtgtcacctggattgggtctctgtccccttagacatgctagatcctaactttacaagggctgaaggggtcttctacacgcaggtcccaacactttgggctggggttggccaccgtagcttagtgggctaaagctggagtttgaatctggatatataggatccacacctatagccatgtgatcttgggcaagttacaagccttgatcatcttcctcatctgtaagatggggatgacaatggtgcctccttcacatgcttggtgtggagattaaatagaataacccaagtagtgcctggcactgagttagtgctcagcacacaggctggtagtgttgggcacccctctcatagccacattcaggggccacctcttaccctgccagcttggctgtgatcacagcccacatcccacttccttaaaagtcccttgttcagagcctctttccaggttcctcgccccacagctttgcaccctgcctgggacttggccctctggctggggcttctgaaaatgtagttcccagagtgcattgaggagggctaccctagccctcaccactcatcttgggctgggttccccagaagcttctgctgagatgaggatgctggagttattagggaggggagagcaagttaagggaggggcagaaggcaaggcagggtgtgatttcagtccaagtcagaccctaaaggggagccctggatgcagtcccacctcagagtaaggactacccaggggtgaagatgtagcctccaggcacttctgctctctggcaggcaggctaggaagctctaggagccccagggtaggtttctgctggagtcgtagggcctattttgggggaagttgtgcacagaaaccaccagagggagtcacaggcatctgggggtgcacccattgacatttgcatccatgtcatgccaagcttgtagcccacaaatgcccaacccttttctccatgcattgctctgtctcagttttgttcacgccaagcagccttggttagttaaatgcagagcttggcatttgcccatgttaaattccttctcctttttcattctggcctggcctggttttgccatctgaagctatgacaagtcctttatcagttttcatccaacttgtcaggcagggcagggctggtatgaagcccaggacatatcactgggacatcccataggtctgtgagattcccaggtccctccaaatccacacggtcatcatgggcaaattagtttaagtctgatctgttaagatccagatctctcacaccaacagcacacacccctttttcccatggccatggaaggagggtagcatagcctgactcgagtcctcgttctcagcagaactggttctgtggtggccacttccctttctcaacttttacctacttctgtttaataggttgttctgcaagtctgagagcaacagcaagcttagaagtgtggactcagcctggtacagtggctcatgcctgtaatcccagcactttgggaggctgaggtgggctgactgcttgagctcaggagttcgaaaccagcttgggcagcatggagaaatcccatctctacaaaaaatacaaaaattagctgggcatggtggtgtgcatctgtagcctcagctactcagggggttgaggtgggaagatggcttgagcccaggaggtggaggttgcagtgagccgagatagtgccactgtgctccagcctggatgacggagccagaccctgtttcaaaaaaagaaaaagacaagaaagaagtatggactctaccttcttgcccttgtggagattgggaactgcctgcccttggcctctttcctgtccatcttgtattatgaaaggctgtttctggcacacccgggctcctctgtgtggtttctgggaagtgactgagggtcaggggaatggagcccctctgcagccggccgctggtaccttccctattgaacccttctttaggtttgctcactctttttgatgggtgtctttccaaagctggctggggacctccctgattgagagacatggggccagttctgttgctgtggctacacgggaataataaagcagaagaacacctgaggaaagctgatgtttactaaaaaaaaaaacaagcgaaaccaaagtgacgtgggcccataggattggggatgggtggtggggtctgactgccttgtcccaagagttgggtgaatgccgcctttgctcacttgtgcggtcactctccaggactcctgcctggcttctcccactccaagcccgagatagcccagcaaggaggaaggtctggccccaaaatacgagctccccaagtggatatcctaaaattcatctttcatggccctactttattgggagggaatgtgaaaattgtgggaatatgtccattgacatctggggctcagggcaggggagtgtgtctagttttaaggtgtgcgcttttagccatgcagtcatcgcccagtctgtcctgcctggagcttttcatttccctgcagctttcctgagaaaagacagagtgtgctttctctgcatcctatgaacatggccccaggactgcagcacctctgtgtgcacacagccaaggacagtcgggggacctctgctggtcctgcacccgctgccctgggtgctctgtcatccccatcccccatttctctttaatctgttcttcttttgtggtttcatgttctctttgttctgggttattcagaacctgtctgcctccccactgtccattgtacttgttcctgcctcctcctgctttgtgccaaggatttacttgccttcgccttctggctccatacagtagtctctcttcttgcggtcttggccattccccccaccaggcccccagctgtggctgtgtctgggtcttggcatttgtgatttacatgggtctaggccctttctctccacctgtccttcccctctttggacacaaaccaaaacatctgagcatctccttacagagggaggtctccctggggttgctgtgccaagtttccattgcttttgcccagaatgagaaatcagttgtcagtggccctgctgggtgaatggaaggactttggtcgggctggaagggcaccccatcagtcctaacttttggtggcccttgttggtggctggctggctaggctgctagagaggtacatcaggtgggtggcacccatctgctggctttaggcaggccatctcctcatccatgttttcagaatcttcttgcatggcttgtaattgggttggggtgtggcctgagcccctgtggggacacactgcactgtcccacctgtatgcttctctgctgtcaggaactggattcgtgtccaagagccaaggctagggactggaggaggagatttctgtctttgacccctccatattagtccattttcatgctgctataaagaactgcctgagactgggtaatttataaaggaaagaggtttaattgactcacagttccacgtggcccggggagcctcaggaaacttacaggaagcctcaggaaacttacaatcatggcagacagcgaaggagaagcaaggcaccttcttcacaaggcagcaggaaggagaatgaatgcagaaggaactaccaaacacttataaaaccatcagatctcgtgagaacttactatcacaagaacagcatgggggaaccgcccccacgattccatcacctccacctgatctctcccttgtcacatggggattatagggattacaattcaagatgagattttgggtggggacacagccaaagcatatcaccctcccaggcctgagcaaggcccaagcagggagcctctgttggggctggaaccctgggaggggtagaattctcccctccactcagatttgttccctgttgctgcccacctggcccctgccctgcagccttctgcctggccttctctctgttcacttctcatttttagcagtcaacagactgggagatggtggccaagggtgtcattttgtacacaagctttgtggcttttgtaagcccagcctgcaactcttgaggaaaactctttggtttgattttttttctcttcagagttgggggtattcagggagaggggcaagggcttcttgtgaagatttcaattcttgaaggtgtggaagcctcctgggctgggggaaggggtggggcaggaaccagcaggggtgtggacacaggggtctggcacctgggataccgtaggacagctgggcaggaagtcggatgctgctttattgaaatttttgatattttatcattttttcattagtttttattttaaaacactgctttaaaataattaaaatatgatttatcttggttaccgaatcacttagtgttgccttaaattttgcgcctagtccctgcctgacctttcctcctcctctcccagggctttaggtactcttagtccctgtgtcatagggactgggagcagataggcccctccgcccaccccacccctcccccacccctcgcccacccctcccccacccctccgcgttcctactctaatctcctaccctgatctgcggtgcagggcggcgctggagagggtggcttgcggctgatcccgcggtctggtttgcggctaggtgtgtgtccccggactggcgtgggtcccgggccaggcgtggtcctgggcggcgcggcccgtgacaggacccgacgcctcctggtgggcatttcgctccaagccgggaccctcggagcctgaggggattcgggagggaggagtcgccgtggggcggggcggggcggggcgggggagggctcccaaggccccgaggacagtcccaccctcaccgacaggaccgtccctgcgcatcccccacccttcttcatcttcgggcgctcgggccaacctggacagcagggcggaagcttccagaaaggacagagatggagaaggtgggaagggtggggctcaggcaggggacaccacggccttaggaatggaagacaggccccacttacctcttcgactccagatgcagctcatcctcacgaggggctggatgaagagggcttcctctctttcccccctaagctgtgcctctgagcctctgtgcaaatatggtggtgcaaacctttggtctgccttcatcattttgttgttgttgttgttgttgagacggagtcttgcaggctggagtgcaagtggcacaatctcgctcactgcaatctcagcctctgggttcaagcgattctcctgcctcagcctcagcctcccgagtagctaggactacaggtgcgcaccaccaggcctggctaatttttgtatttttagtagagatggagtttaaccatgttggccaggcagctcttgaactcctggcctcaagtgatccaccctaataaacttgctttcactttactctgttggctggctcttgaattccttcctgggtgaagccaagaaccgacgtagcctcccaggctgaacctcagtttggggctttaccccatgacacccgcaaagggctgggcttcccttcttcttggggagagggtcaaggaagtggctgtatcttgaacacccattcctctttccttccatgcgcacaaggcctctctgagctgctgtcttccttaggacactttcagctacaagtaagttaattttgaactgaaagttagctaaacaattattatagaatgttcaccttcccactgaagaatttaggaggtaactggcttctgggtgggctgtgtggctcagtgtggacatggattcaggttctttccatatttgtgctgtgccatctttagagcgtagtgaaggctgtccttagccccacgatggctgctgcatttcaactctggaattcagttgctggaattcacactccagtctgtgtgactccagggcggtcattttgtttgtcttttcaaaaatgaaagtaatacgtacttatgataagaatttaaaacagtacagacctcggccttttgttttattcatgataggaatttcaaatactgtgtaaactgaaggtctgatcctcgcccttgtctggaattcccgcagattaccactgaagatgttaataatttccatgggccttccacaaacttccttggtaatcacaagctcagacctctgaatattccatacaagtgagatcccacttagatactattctgtattaattctttaagataggccaggcatggtggctcatgcgtgtaattccagcactttgggaggctgaggtgggaggatcacctgaggtcaagagttccagactagccaggccaacatggtgaaatcctgtcgctactaaagatacaaaaattagctgggcgtggtggcgggtgcctgtaatcccagctacagtcaggagaatcgcttgaacccaggaggtggtggttgcaatgagctgagattgtgccgctgcactccagcctgggcaacagagcgagactctgccaaaaaaagaaaaaaaaaattaagatatgtcttgtagataatactgccacatataacaatattttctttattttcttcctgggcatattgtatggcatagtatacaagtgccttttaaaattaaaccagacttctttttctggactttatgttacacctcacattttttttaacttaatagatttatttcttagatgagatttaattaagagaaaaagtatgcagaaaatacagagttcccctacactttctcactctcatacactttctcctattatgagcttgcatagtgtacaacatggtacatttgttacaattaatgcaccaatattgatgcattactgtttcctaaagttcatggtttaaagtttactctttgtgttggacacttctctggattttgaaaatccatgtggtgtatctcccactccagtagcatacagaatagttggaccacctaaaaatcccctgtgctccgtccattcacccctcttaccttccccaggactcctggcaaccactgatctttttactgtctctatagttttcctgaatgtcacagagttggcttcatgtagcatgtagccttttcagacaggcttctttcacctagcaatatggatttaagcttcctccatgtattttcatagcttgagaactcatttctttttagtgctgaaaaatgttctgttgtctgggcatactgccatttattcatctaccaaagggcatcttggttgctttcaggttttgactattatgaataaaactactataaatattcatgtgcaggttttgatgtggacatatgtttacttcagttggttaaatacgcagggcaacattgctgtaagactatgtttagcttcataagaaactgccaaactatctctgtacaatttcgtattcctactagcaatgaatgagagttcctttttctcatataaaaataaatatccttgtatgtatagttttatgttcaggtgtgagtatatctgtaggataaatttttcatcaagtggtacatgtaaaatatctaccggtattggcaaattgctccccagaaagattgcaccaataatacatgaaaacgcatattttctcatacccacgccaatatttgattgttaatcgaactttaatattttggctaatttgataagtgaaggaacaatgtcttcctagttattgtgatttgcaatctgttccctgtgagtgaggttgtggtctgccggactgcgtgagtgagaattcctgttctggcactctcaagctgtgtgatgctgggaaagttgctgaacctccctggacctcagtttcttcatctatagaatgaggatggtaatgggtctttaccttattaattggattggaggatttaatggcatcattcatgtaaagtgccagcacagttcctggctcaaaataagggccaagtaaatgtaagctattattattctccaatatgttcataagcacttgaatttcttcatttctgatctgcctatgttcatatcaatttcccaggattttttcttattgattggttagagctctttgtatattaataacatacgtttatttttttcatataagttacaagtatttttttattccagtgtttcatttgtctcctgtttatcagatcctggctccaaaccagtgcaacatccttctcagggacacagcattttaaatcttacaaagcccctcatttcccatctgtcatttatgtctcaggacatccacatgaggcaagctgatgtatttttcagtaaagaaggagactttattgaccaggcagggcgagtgacttgcctaagggcacagaaggaattagtggtttgtacagactgaaatggagggtcctggcccctaggtaccacctcctccactcttaaagaaggggagagggaatctggaggtgcaggaaggaaaaggtcaaggtcatcatgacagacagcctcaccccatcccctctcagaacccaagagcctgggtccttttttttctgttaagttctgaccattctctcctgataaatcaagggaagaatgcgagtaaagggtatgtgttactcgggcgagactccctgcttggaaggtctaggaggggaggtatgtgtgtgagtgtgtgtgtgtgtgtgtgtgtgtgtgtgtgcattctttctgtcaagttgcccagcaggtgagctgaaagctggctctcttaacttggggatgagcaatagagtcaggtctcggttcgtcattttccaatttcatcagctttgaaaatattttaataataaaatccaagcatttgattttcctgactagttgtttattctgatttattggctatgcatggtgcctgaagctcctccaaactcccaagggtatccctgcatgtctcaggatgtctcttaacccagtgccatgtgagggacagaacctagaccaggcattcagagccaggtaccattgtgcctaccctactcactgctagatgatgctagtgaggtgctcacacctctctgggcttagtccctccattgtaaggcaaatgggaggcctgctgcctctgccttgctgggttgttggtatggctgaaatgaggggatgaaggtgatgtggaaaacttgataggagagtggctgccgtgtgtccattctggtctcctttgtctcatgtcaagcccagggactggttctttttctctcttcgggtctgtgacttctgggaatcctgcttgcctcggtgccccctggtgaggtggtgccatataggttgctttagcacatcaccgagagggactctccaaaccctatgctaagtgttcaccgccagaacacttgcatttgggccagaccgggctagggtacctaaccatagcttcctgggttcatttcacagggtggacagcaactgagagatgtccagggaaatttccctttttaagagataggggttctggggcccataagggcaggaagtatccccaaccacaggcaagttcatgaagcccatagggagtaggatggagccagttgccaggagcagggaaaggttcatgtctttgctcctccatgtacccagggactcagcaccacctgcaagttgatggaaaggcagaatctcagcacactctgagcccccgaatcagagtctgcattttaacagaacccctaggtgaggcagaagcccactactccagtatcattcattcattcactcacctagcaaacatgcctgaggccgactctgtgccgtgccctgtgctgacgaagaccggccaaaagaccttgttctggtcttcctgaagctcaggtggagcagacaccccaacggccaacaaatgtgaagattgagaactgtgatgggagcctgaggtgggagcagctaagcttccctggggaattgggggtcagggaagtagtcccaagaggctgagtacctcctgtgtggcaggggcagggtggcctttgctccctagtatcttttttttttttgagatggagtctcactctgttgcccaggctggagtgtagtggcgctaccttggctcactgcaacctccgcctcccaggttcaagtgattattctgcctcagcctcccaagtagctgagattacaggtgcccgccaccatgcgtggctaatttttgtatttttgctagagacggagtttcgccacattggccaggctggtcttgaactcctaacctcaggtgatccacccaccttgtcctcccaaagtgttgggattacaggcttgagtgactgcgcccggcctgtgctccagtatcaaaacctgcaagcacctacagagtggagggtgctatggtcagggtggtgctcaggtccagactgatggaggaacctgagcaggggcggggaggcatttcaggaagagggagcagttgctcctgcacaattttgttgcatcgggccaagcaggaaggctggagaggtgaggaagagccccgggggaaagcatggaccatcagggaaaagtcagacattgccctgttgctaaaggcactcctggatgggttttagcccggggagacctgaatcaaattagggtgcatagaaagaccatgatatccccttgatggggaggagaaagaggagaaacaggaggactaggagggaaagccgaggcgatttgactcagcatgagtgagatgtggggcagggagagagagagagagaaagacacaaagagagagacaaggagagacaaaggggagagagagaggagagagagagagagaacagagagacagaggagagaaagagacagaggagagagagaggggaacagaagaaagagaggcagagagacagtgaagagagagaaagagagagagattgagaaagaaactttgcatccgcaggcctgggccccatgcagcactgacagtggtaggcagccgacgtgaagcaggaggcacaggcagggaggatggacacagcacctcccacagcttctgagtccttggtgcagaatgtttatggcacttttcttcgttctttcttaagacttatttagtactcatcttttctcctttactccattgtgagcttcccaatgataggggcactgtctctctcatgtctgtcttcccacattgcttatatctaggatgggaaatgcaaggctcccaggcaatgcttagttaaaggggcaaagggctgtggtcttgtcttaagtctctgccaggctgaatgcctagaacttggccctcaggagggcctgagtcactgtgggacacagacttttaaaaggtgaaacagccaccagccaggggtgaggaactaacagcagacacattgcctgattttaagatgtactataaagctacagtaatcaactaagtgtggtattggtaaagaatagacatagatcaatggaacagaatagaaaattcggaagcagatccacacatgcacagccaattgattttcaacaaagatgcaaaagcaattcaatgaagataatcttgctaacaaatggtgctagaaaaatagaatacccatatgcaaacaacttatttatttatttatttatttatttatttattttgaggcatgtcttgttctgttgcccagactggagtgcagtggcgcaatctctgctcactgcaacctccgcctcccaggttcaagcaattctcctgcctcagcctcccaagtagctgggattataggcgtgcaccaccacgcctggctaatttttgtacttttagtagagacaggattacaccatgttggccaggctggtctcaaactcttgacctcaagtgatccgcccaccttggcctcccaaagcgctgagattacaggcatgagctaccacgcccagcctatttatttgttttctttgtataaatttagggggtccaagtgcacttttggtacatggatgtattgcatagtgtgaagtcttggcttttagggtggccatgacccgaacagagtgcactgaaccctgtaagtaacttctcatccctcgccctgctcccaccctgctgcccttctgagtctccactgtctattatgccatgccgtatgtccatgtacacacattatttagctctcacttgtaagtgaggacaagcagtatttgactttctgcttctgagttattgccttaaggtaatggcctccagttccatccatgttggtgcaaaagccattatttcattctttcttatggctgaatagtattccacggtgtatgtgtacacacacacacacacatctataaaatatattttctttacttaatcatctgtcatatacaaaaaagatttatcttgattcatacttcgcagcatatataaaaatgaacccaaaatggatcacaggcctaaatgtaaaattgaaaactaacagatacaaacaaagaagaaaatgtgtgaccagggttgggcaaatatctcttagatgtgacacaaaagcatggcctacaagagaaaagtgaataaactggctatctttttttttttaattattattatactttaagttctagggtacatgagcacaatgtgcaggttagttacatatgtatacatgtgccatgttgatgtgctgcacccattaactcgtcatttacattagatatatctcctaatgctatccctcccctacctcatcccacaacaggccctggtgtgtgacgtcccccttcctgtgtccaagtgttctcattgttcagttcccacctacgagtgagaacatgcgatgtttggttttttgtccttgcgattgtttgctgagaatgatggtttccagcttcatccatgtccctacaaaggacatgaactcatcattttttatggctgcatagcattccatggtgtatatgtgccacattttcttaatccagtctatcattgttggacatttgggttggttccaagtctttgctattgtgagtagtgccgcagtaaacatacgtgtgcatgtgtctttatagcagcatgatttctaattctttgggtatatagccagtaatgggatggctgggtcaaatggtaattctagttctagatccctgaggaatcgccacactgtcttccacaatggttgaaccagtttacagtcccaccaacagtgtaaaagtgttcctatttctccacaacctctccagcacctgttgtttcctgactttttaatgatcgccattctaactggtgtggtggttttgatttgcatttctctgatggccagtgatgatgagcattttttcatgtgtctgttggctgcataaatgtctttttttgagaagtgtctgttcatatcctttgcccactttttgatggggttgtttttttcttgtaaatttgtttgagttctttatagattctggatattagccctttgtcagatgagtagattgcaaaaattttctcccattctgtaggtttaaactggctgtctttaaaattagaaacttctaagctgggcacagtggcttacgcctgtaattccagcacttggggaggccaaggcaggaggattgcttgagcccaggagtttgagaccagcctaggcaacatagagagaccctatccttataaaaataaaaaataaaaaaattaaccttgtgtggtggcatgtgcttgcagtcctagcaacgtaggtggctgaggcaggaggctgaggtgggaggatcacttgagtccaagaggtcaaggctgcagtgagccatgattgtgccactgtactccagcctgggcaactgaccaagaccctgtctgaaaaacaaaatccaaaacttctactatttgaaagacacagttaaggaaatgaaaagacaaaccatagagtggaagaaaatattttcaaaacacatatctgataaataacttgtattaaggatatatgaagatctctcaaaacttaacaataagaaaacaagcaacccaatttaaaaatgggaaaatatttgaacagatgcttcatcaaaggaggtatatgactggccaatagttatgtgaaaaaatgcccaacatgcttagttatcagggaaatgcaaattaaaaccataagatcagaccaatgcatacaaaatggagtggcttaaaaaaaccctaacagtaccaactgccttgagggttctcagtaccaactaagaactcttgtacactgctggtaggaatacaagatgggatcaccactttgtcaaactctgtggaagcttcttataaagtcaaacaaatatttaccacatgacttaccaaacatactgctaggtacttacccaagagaagtgaaaaattatgtttgcacacaagcctatccaccaatgtttacagtagctttatttattatcaccgaaacctgtaaacaaccccaaagcccttgaacaaactctggtatatttatgtaatagaatgcttatcaataaaaaacaatgaactaattatatatatatatatatatatatatatatatatatatatatatatgatggataaatctcaaatgcattctgctacgtgaaagaagccagactcaacagctgcgtatctgaattattccatctgtgtgaattctggaaaagggaaaactattgggataggaaataaaggagagcttgccaagggctggagagtaagggaaaggctgactacaaagaggctcagatggatttggggagtgaaagtgtcctatatttttactgtgatggtaacatggttgcgtttgtcaaaactcatagaattgtacactaaaaagagtaaattttatcatacacttatatcttaatatacttttcagaaagcaaagtatgtaattatacagatcaacaggaagaacaaataaaaccatacaatactcacacctgcaacataactagaagacacagaacactataatcttccaattacccaagagaataaaaataagcaaccattaccagtggagctctttctgaagtttctgccccaaaccttgtcaccgagtaaggcagagcctggataaaactgcatgggaggtgcatggatcacctgaggtcaggagttggagactagcctcgacaacatggagaaaccccgtctctgctaaaaatacaaaaaatagtcaggcgtcgtagcgcccgcctataatcccagctactagggtggctgaggcaggaggattgcttgaaccccaggggctgaggtttcagtgagctgagatggcgtcactgcactccagtctgggcgacagagcgagactctgtttcaaaaaacaaaacaaaacaaaacaaaaaaacaacaacaaagagaaaaactgcataggagagagaacaggggaatagagtgctcaagactgagctaaaaccatccccagaaagactggaaacagcctagttgtccttcaatagctggatagttaaaggttagaccagcatggtacatccatgccccaaaatgctgctcagtagtcaaaaggaaggaactgttgtctcagaatgcggatggatctccaggtcattctgctgagtgaaaacagacaatctcagaaagctatctttgtgtgattccattgatgtaacactcttgaaacaaaattttagaaatggagagcacattagtggttgccaggggttaagcagatgtggctgtaaaagcgctgcgggagggatcccgcggtgacggagcactctgtatcctgactgtatccatgtcaacaccctggttgtgatgtggtcatacagtgttgcaagatgttacactggggaaaactgggtacagggtacagtgggcctctctgtatcattgcttacaactgcttgtgaatcatgactctacagttaaaaagctcggtgaaaaaaaaaaccctcatttacaatcgcatcaaaaaatgtgaaatacttggagataaatctgacaaatatgtgtaggacttgtagactgaaaactacaaaacattggtgagaatgaaaggcttaaatcacagtacgctaacaatagatggatttgatgaatgtaagtgaagggaaatagtgttgatcacagacctgaaatttttctttttcctttttttgagacagtcttgttctgtcacccagtgtgtagtgcaatggtgtgatcacagctcactgcaacctctgctccccgggttcaacaaattttcctgcctcagcctcctgagtagctgggattacaggcgcccaccaccacgcccagataatttttgtatttttagtagagacgggagtatcaccatgttggccaggctggtctggagctcctgacttcaaatgattcgcccacctcggtctcccaaagtgctgggattataggcatgagccaccatgtccggcctgaaatttttcaaaataaaatgctggtaagagggaaaaaacaaaaaaagcataggaagaagattttaggaatgcatagttagttctgctataacacaatatatgtgttcctaaaaaaccagtgctctatgcaaaaatcacataataaaaaccactgggcttatgggaaaagtggggttaaccgcacaacactccaaaattttgtcagtagcccataagaaacaaaaagataggaacttaataaaaatagtcattgagttttgcacgtttgatggttaagaaaagcatgtatattgcaataaatatgacacttgatcttgaaaaagccctggagtttgtgtgtggacgtgtgtgttaccagacatggagctgtaacaccagatgtggatggatgcagctcataacacacgaggtggatgcggagctgtgggcatttgaggcatccatctgggtgtattttggctcggttcagttgggtacaactttctgtgctcacctagagtttcttgtagaccacattgcacataagcaagtgtgaaattcacatcatgctcaaattgttccctaatactgtaactcaatctcatgggaacaaatttctgttttcaaaacaagtattaacagaatggactgtgcttgttaaagtcacaggtggcaatcatcaacaacttgttagacagtttgctctttaaatgcatagatttctaaatctaaaaattaggaaaaaaaaaaaaatgaaacctcatgcccaggtgtgaccatttcttgattgcatcctcacaggattttgggttgaaagaaaacaaagtccctgattctgccacagcccacccaagcatgtcctcagaggtggcattgaattgtcccattgcactgtcccctgttgtctgagactgcactgtgggccaaacacccatggcaggccccacggaggggactctgataccatgtcatctccactcagtcatctaattagatgttggtcaggtacccactggaggccggacagcacataaaggtggggagggggtttgtggggggcttctgatggagacgagtagaccaggtgagtactaaatgactcaatctagatgagaggaagaaagggtcataggtattcattcggaacccagaaggcctcagacaagtgctgtgcacctcgccctggacaacccagcagggtcaccctgcagctgcagggcaggctctgagcttgggcgggcacagactctgagcctgggcagcctgagggtacagagggtgccagaattaggcccctttcgttgcctttgggagatcaatgcctgcaagggccccgatgcagccaggtggaaggggctcagcgtggggacagtctctcccatgtgctggctggcctggggacagctttgcctctgcggattagtgtgagaggtcaggacccccatgaagccatgccccccccccaccaggacatgagaaggtaccagctcctggagttttgtgtcccaggcctggtcgggacacttgggctgccagggggcctggtcctgggccactctcaggccaactccaggctgaggaccgggagctggaggaaagggctggtggtctctgaaccactagcttccctgtggttcctgccctggtggctgaggttagtgcgactcccctcaatccagcccggtccagaacgttctgagttggggatgggagcttcttcccaccagagaaagcattgcaaacctttttgtggtgaaaacatccaaatggacagaaaactagagagggtggatccatgaccctatcgcccatcacccagtgggcccagttcttgactctgttttgccaagaagggggatcaagtccccagcttttgaagatatgccagactgggtttgaaaacttccgcttctctcagacagagcactttccaacccttggccctagtgggtccatctatgatgcggagacaggaatcccaaactcagagggggctgcgaagatctaatgaaggaacctttgtgaggggctccctggagaggcagacacactgagggtgaggaattcaggttggacctgtctccggccacagccagtccagggcttagcccatccttgctgtgtgccgcagccccttgctctcagctttgactctcacaagcctcaggtcctctgtaggcactatagagaggcgatagtcaggccccactccatcctcctcctccctgctgcccaccgaggttccttcaccatctggacatagccctgagcccgggctcagctccagtcccaaggcttgggcttgcagggcatcagctccagcgacctgccttctccccccatcgagggctgtgtgacgtgtgtgtgcatgtgtatgatgtatgtggttgtgtgtgtgtggtatgtgtgatgtgtgtggtcggcagtcagctgggtaggcctagacctgcccagtgaccccagggacaaaggagcagtcctttcggatcctcccagcgcagggatcctctgatggacaaggagacgctgcagtcagaggcactgtgttttcaggacagactgaggcaaagcattttggcaaatggccttggagccctgaacaccctgagaccttgtcaccgccaagcccccggaccaggtatacacagcaattctaaatttgctaatagcctcattaaaaagcaaaaggaaacaggtgaaattaattttcataatatattttacttaacccaatatatctaaaatgttaccatttcaaagtttaatttgtatatgactgagatattttgcatttctcttcatgctccgtcttcgaggtctggcatgcacccggcactcacagcacgtctcagtgggaccagcccggcttccaaggctcagcagccactggagacagcacaggtctagtgcagttgctctcaactctgctgtgcattacaatcacctgagagctttgaaaaagtgccagtttccgggctgcctgggaaccccctcatagttacatgggaatctcagggaggggtggggcagacaggggtcactgatcctggggtgggaggtgtcacagccccacggaagggcttcccatcagagggaacagcgtgtgcaaaggcaggggagtggggaagagcaatgtttagggggaactgtgagtggtggtgtgtgtgtgcagttgtgtgtgtgattgtgatgtgtgtgcacatgtgtgtgttgtatgtggtatgtattatgtgtgtggtgtatatggttgtatgtgtgtggtgtggatgtgtttggtatgtgtgatgtgtgcagttgtgatgctgtgtgttcatgtggtgtgtgtgtgtgtggtattctgtggtgtgtgtggtgtgtgtagtgtgtggtgtgtgtagtgtgtgtgtgtggtgcagtgtgtgtggtgcattgtgtgatgtgcatgtgtggtgtgtgaggggggtatattctgtggtgtgtgtgtggtgtatatggtgtgtgtggcgtgtgtagtgtgtgtgtggtccagtgtgtggtgcagtgtttggcatgtgtgtggtgtgtgtgtggtgtattctgtggtgtgtgatgtgtgtggtgaaatgggtggtgtgtgtgtgtggtgtgtggcgtctgtgtgtgatgtgtgttctgtgtgtgtgtttgagtggagagatccttcaacctgaaggatcctgagcctttctcttcaggacaggtgaggacaccttagctggtggctgtgtttcctgcgctggggagtcagccgagcggagccccaccatggctaggtgttacatatgttcagtatcacctctgacttcaaaaaagcgagcacccccatttccaggaatcgcctgggaaccgtttcaaaggagtcgtgccagccaggacagagagctgggaagcgggaccacaggagcaactctgaacagtcattggatgcgctctccaaccagctgctctgctcacctcaaagcacacaccaaagagagggagaggctctgagcccatgcgggtgaatcagggtgagccacgcaaatctgctggcccctggcagtcatggcagatgctgccaggaggcctccctcattactcggagtaggcttgaagtcatgctttccagtgtgaggtgcgcgagccaagcaaaggaggaggcctggtcaggaggggggagttccctgtgacaatggaatgaaaaggctgctgcagggcccagctggccctgggcacggtgtggggaggggaatccgcaaaccaggcagagccctccagcccagggcgttagttgttgacccatctttcctccccaccaccagactgggagtcctcatcctttgcgctttgcagtttaggaagcaatctctgaagagcacaaacctatttaacaatgataaaacttcggctttaaagggctgatgtggcacactggcactagagccaggacacatgagggagatctctcttctcctgctcagcagctggcctcccttctgagggcccacctcggactgactggaggacaccacttggaatggcaaagatgggggcaatgcaaaggccacaaggatggcttcatagacaggatgtggacttggcattgggcagacctggatttaaattccagctctgcctcagtctgttttccattaaatgaagatacttgtgcaagggttctgtgagaattccagtggctgaagtgtgaagcattccccactcagggttgcacagctgggactgggtgaacactgttagtaccctcaccctgtgtgctgcagctgcatcagggccagctgcccttctcacaagcacctatgcacagatagcccccatttcaccccaaaggacaactattcagagaattaccatccatcaagccagggcactccaatcagaggaaggtgtcacttcctggtaggacaactagaagggcaggagctattcactgagcataagaggaaggcatggtacaggtggggcatttgtggagagcaagacagggagcagagaagtttctggcaacatgctgctcccagaggaatagggctgccacacctggtaccaggaaactggggaatggccacagctcagctctgccactcaagaaccccacttgccacctgcataggaaaagacaacattgtggccacagaagggtgaggggccccacagaactggggatgccaggacacttggtccatgggaagctgccttttgctctggcctgtgcctggaagcaaaaccatcatccataactccatctaaggattcttagagcagatactagctggaccacaaggggcagcccaaacctttctgttccatcccatggcctggcccttgctggcccacagctcacagaatctgctggggctccccagctcaggcagtacaatactctgttgaccatacgctgacaggtcaggcactgctcttcctagttggacctgatactagtcatgattcactcacctatgcagaagcctgtgcatgcaacaaggcttagcccttctcccatggagatgaaccttttgttcctccctcctgctttcaccacccccaccctacccaaagaagaggaagaaaacagagtagctttggcaaccttttctacccctctcccaggcaagaaaagcagaagaacaacctgaagaaccaggcttctctcctatatcctccatctcgccttcagcctgcatcccttcttactaccctctctccattataatttgctctctgtacattttaaatcaatcaaattagcaaaataaatcatgaaaaccctatacatttataaacatagtaatatgtgatgctcataagatgcaaggagatgggtactttcatagtgttgatagtaggaatataaactgaaaatgctttttttggtaaggcaatttagccatttatatcaaaacattaaaaatgttcatccctcagacccaggcattcagtctcagcaatgtatcctagagaaatctaaaatacaaaagtcacaaagctcaatgcaagaaaatgttatcatcttgctaattacaaaagtggaaaattgaaaacaatttcaatttacaatatatggaactggttaagtaaatatagcaatgggatacaacattggacaggctctaaaacagtgtttaaccagaattattaaacattcattttgtagtatgaagtgactatagcaatgtaatacaacattgggtagactctaacatggtgtttattcagaatttgttttgttttgttttgagacagggtctcactctgttgcccaggctagagtgccatggcatgatcatggctcactgcagccttgacttccccaggctcaggcaatcctcctgcctcagtcttctgagtagctgggactgcaggcatgcaccaccaatcctgtctgttttttttttttttttttttctatttatttgtagagatgggatttcaccatgtttctcaggctggtcttgaactcctgagttcaagtgacccgcctgctttggcctcccaaagtgctgacattactggcatgagccactgtgcctggcctattcaaaattctaaatgtttactttgtagtgtaaaatacatgtggtaaatttattttaatatggatcctataaaatttcatatacagtatcaatctcaaagacatttaaaggtttttgtttcaaataataggaaattgaatgaaaaggaataaagcaaaatgttgactggttgtcatcaagtaataactgtgtattatttattttcattcatatattcctaaattttctaaaaggtttatactgttttgaattttttttaatctttaaggaaatcaacttttatagcttagagtgggtaaattttaattaatatgttccttttgtcaggaatatttgcaatctaaacacactttaaactttggcttttctcttgtaccaccctgttgccatttaccaaactatagtattcacagcctatatgtttattattgcttcagtcctcattgattgtatcctatggactatgcacctatttaatcctcatacagagtatactctgtaaagtatgctgtctgacactgaaagtcagaaagtttgagttgcttgctcaggacaccaaaggtcatcagcagaggctgcttgatactgtcagtacttttcagatagtcactctatcagggctttagtccacagtgctcctgtggatgctaaccctacctgggattgctctccttttccttgagccctcctgtcttaggctgttttgtgttgctataacagaataccataccctgggtaatttataaagagaagaaatttatttggctcacaattatggaggctgtgaagtccaagagcatggcaccagcatctctgctttcatgttgcatcatcccatgatagaaggtggaagggcaagcaagcacatgaaacagagaagggagggggccgaacttgatccttttatcagaaacccactcctacaataacagcattaatccattcatgcaggcagagccctcatgagctaatcacccctcaaagcaccctcctcttaatatcatcgcaatggcaattaaattacaacatgagttttggaggcaatgctcaagccatagcacttctcaagaagggcaccagcagaatatgcttgtgatcgctctgaatctccatcaggtcatagcatggaatgaaggtatctggtttactcaagcatccctcccacggcctgaggtcccaagattggattttctgttcccatcattggaaagcagaggaatccttgtggaagtgcatctgccttcacaggaccacaccaggagcaggaattgtaaaatccacctctgctctcccaagagagaaggagagggagggaaggagcacatttggcaactgagagcatgcaacagaaaccattccttggagatcctatggggcaagcaatggaagggacactaatttccatctggaaaagatatggccagagctctgacttcaaactctggaaggaaggtgggggctgacccctattgaggatcttctgggcaccagatgctggactgggtatttaattctagtcaatttattgagggaatgagactccaaaaggtgaaataccttacccacagtcatgcagctggtaggtgacagagatggagctgaacccagactcttcctcttatccagtcacataccgagaccctgcattgccgttggaagctatttgcctttcttctcagcactctgggtgtcgtttgcgtgctctctctctctctttctctcagtaacttcagactagagaatggggtaccaaggtcactgataaggaagcccagggcctgggggtaaattttagtgagtcggcagtcctcaatactcagacagatcatcttcttcatgatgatgaagcaccatcaggagcttaccatttggagagataggatggcttaaccctgaatctgtgcctgactggggtctcataccctggggattttatagtgtaagctcaggaaagggattctgatgcctgagcagagagaatgccctaattaagaatgacggccagtttggacaatctccctgaatcccaccgacaaaagaaacaatggcttcccaatgacatgggtctcaagatggacttgggcagagcaggaacatgcaggggggttggtggtcttccaggaggcagggataaagcccccagcaggaggaagggccccccaaggctctccttcctatctctatctctggtcagtatgagactgagtcattcacttagctaaggaccagacaattaaagcacaggaacagatccaagcagatgtataaatctattatatggtgaagtcatactataggtcagtgaggaaaggatgagttccttaaaaaatatattgacacatctggttatccatttttaaagaaaataaagttaaattcctatcacataccatgtacaaaatttccagatagattgaatagctaaatgtaaataaataaataaatacacacacacacacacacacacacacacacacacacacatatatattatattataagaaaatgttgtgtaaccttacaatgaggatttctacttaaataaaataggaaacctaggcgaggtgtaatggctcatgcttgttatcccagcatcacttgagctcacaagtttgagaccagtctaggcaacgtggcaaaactccatctcaaaaaaaaaaattagccaggcatggtggtgtgtgcctgtagtatcagctattcgggagactgaagtgggaggatggcttgagcccaggaagtggcggttgcagtgagccaagatcccaccactgcattccagcctgggcaatagagccagaccttgtctcgaaaaacaaacaaacaaaacaaaacaaaacaaaacaaaaaacaggaactctagagcccataaagagaaaaactaacttgataaatttggttacataaactttttaaactcctgattttgtaagccattaaacagttttttactagactagaagaaaataattgcaatacttaaaatagacaaaaggtttatatccctgatatgaaaagtttatgaaattaataataaaaagacgactataaaacagataaaggacacaaagggcaattaacagaagagattatacaaatgaacaatagcatgttacaagacaacagtgttgggataatgcaaattaaaattcatcagtttagcaaatgtttaaaatgttggtaccagtagtctaattttgatgacactataaattgctacaatgattttgagaattaacctgacagttactgctgacattttaatctggatgcccttggatgccacttctggaaaaggccagggatcataatcaaaacattaagttactcttacatcacaagcatgccctgatcagaacagacactgaccacaataaccaacaagactgtagcatacttaaaaatagatgtatacgagtatgctccttgtacaattgtttatgttagcaaacaaacaagcaaacctggaaacaatccaaagtttcatctatagggagaagaataactaaattatgaaggatcatcaatctggaaccactgcagctctttaaaaaagaaaaagaaggtaaaactactattattgccctggcaggatatccactatagctgtaaaaaaaaaaaaaaaaaaaaaaaagtttagaaaataaaaataaacaaaggaagtaattcaattgtagctcttcaaactgagatggtaataacagcaattacttaagtacagtgtaattatgtcttcctgggggttggttacatcttggcaaagtttatcacagcaagaattggttttggcttctggggttggagccttagattggagatagaaaaaaaacctcaaaggaagcattcctgtccagaaggtaaagtgattcccacccccctcttccctgctacaaaaggtcatggctttggggggcactgaggtctggcatcaacccttaagtttatttttcccataaggaaaagcacaggagtctcatgctagcactttagagaaccaagcatgtggatctacagttccagggaagtccctgactcggggacacccttctcctgaaatccccacactcagtcagggccctgtcatgtgttcccatggcccccagttctcttcttggtggcacataccacacgggtcatttatgttaggatatgtacctctttttccctccatgagactctcagggggtcaccatcatccccagcacctagacagtgcccagagctttgcatatacagggtaaatatttaccacgaataaatgaaattagtaaggggctacaagaacccaagatgattgaagagatataccaagaaatgatcaaatgacagccagagtgtcagtcactcagctggttccaaatgcctaataaaaattaactccctctgtccttaccacagccctatgaggtggccacacttattgtgctcactttatgatggggaaacaggagcatagaagttgggcaactttccaaagtcacaccgtgagcgattccacaacaaggggttgaacccaggctgtctgggtccagaggtcttgttcttaaccacagtgggctgctgcctcttctccctaagctagtgcatcctggaggtcctcagaatgacttgaactggccagagggtaaacgtctgctgaaggaatgaatgggcaatgaatttctaggaacctggggccctggggtctgggaaggccgttgcctccccaagggaatgacacagggccagtctgctctccttctgtgtgggcccctggacactggtctggcattgtccagacaccaaagcacatccgcatagcatgcatcaaacaaatggtgacctgctaatgaggaaatggctaaaacaggaagccatgaccagagtacatgcttcatgcctccagccccgcattgggtaatggaagggcaattacttctccacctcttcacctatacagggcagacttgcctagaagttcagagtccttcctgccaatttggcatcctttcttccagagtgttcccaggctaggtggggatgggaaaagccacaaggagcacagcaggatgatagagatgtggccaatgggcaatgctggcactgccaccctggccagaagagctcactgtgggacactttctcattgtttactagggaagaggaggttggtttggaattcattttgatttgttgttgtaaattctctttgctgtcccaatttaaacaaaaaagaaaatggagaaggggagtttttaatcaaatggattttcacttgggttttatcatgaacctggaactgctttgaaagctgaagccagctgggcttctgggtcgggtggggacttggagagcttttctgtctagctggaggattgtaaatgcaccaatcagtgctctgtgtctagctagaggattgtaaatgcatcaatcagcattctgtaaaaatggaccaattggcactctgtaaaatggaccaatcagcagcactctgtaaaacggaccaatcagcaggacatgggcggggccaaacaagggaataaaagctggccacctgctccagcagtggcaaccagtccctttctgcactgtgggtgttttgttcttttgctcttcataatgaatcttgctgctgctcagtgtttgggtccgcgccacgtttaagagctgtaacactcaaggggagggtctgcatcttcactcctgaagtcagggagaccatgaacgcacctgaaggagcaaattccagacgcccacctttaagagctgtaacactcactgtgaggtccacagcttcattcttgaagtcaccaagaccgagaacccaccagaaggaataaattcctgacacagcttgattttgtctttggtgagaattaagaagggtcacatccactgatgaccagttgggggatagatttacactggctatgcccagtggtactcaaagagccacaattactctcactgtggagcttccttcagtgacaccagagaccaggaagggagctacctaggagacctcagcctgtggaaatcaaactgtggtgtgagccctcctgttagcgagcagtggtgctggctgccttctcacactgccacttggcaaccagaatacagggacttcaccgtgagtttgagctaaaacttgcctgctagtgaatcttagcataggtaattttgggttaggagaattttggtttctctgatgacttggttgacatctttgagattcagcaagccccaattcagattagacttaaaacttatcagtgcaagtcagacagcagtgattactctgcttgttgagacctagggacatccgtttgaattcagtccgcaccccatggacgagcccagctcaatgccaggaagtttatgaattcctggggccttctagtctcatggttacatctgctgccaaaaaccagatcctatgaagttagttcagtttagtgatcttctcaccaagctgcaggggccatcctgttttgtaccatggtgatgaggcacagagcacaccctctttttaccttcaaagaaagaagccagacattgatacaggttactgtgtatgcagcagactatcctgaaggtttagggagacagagtattgatatctcagatctgcaaacaacagaacagccccttggggatcactatgatccaggcagaaggcagaatttgttttttaatcaaatcaccaattaatgactgaaaacagtatctcctggaacaagaaattattattcctctaggcttgaaacaatatgaaacagaggaaagttatttgcaaaaattggctgaatgtgcaaattatgcttccacgtgaatagcaaagtaattaaaaccattttcagaaagtgaactactttcttaaaacagcatgccgaaagtggtccagagttcaagattttgaaaacaaaaacaaagttggtacttgaattcacagattgaagctaactagaagtcaaagaaaagacacactggattatgagaaggagcagggatcacagccaggtgcagaacaaagtctgagcgtgcctgaccttccctggaggttccgcccatgtcacctgcccactgggtgtttcctgttttgaccatgcattccttagaccttctgttgttaaaattttttctccttgagaactttaactggccagaaattagaatccaattttgaaaataccaagctactttcattatgacactgcagttaagcaaatattacccaaatttggacagccttgtccaaatttgttttatattgttttatatttagcaatataaagcaaagtgtcccatttaaaaattggtaaaaccttataatcaatatgcattaaaaatttttagtatcacatcattattaatggcaaaaatttccatttataaataacagaacttttgttgattgtatttattcttccatcctgggatttggggttttttcaattttgttttttaagtttgtttttaattttttttttttaattcagaaagagaccttgttgccaccctctgcatactcagaaaggaaccccagtccgtgcagaaaggggccacggacagtggctgtccacccaggatgggcccaagaaaggagtcgatgtcctgaaacagtccctgcccctttcctgagtgttgggggatggtgggaacgacgaccatgtagctcctaacaaagggcgtctgcctctgggggtgtcctggggcgtggcttactgagggcttactgaattttaaaaattcagatttcagccaggcacggtagctcacacctgtaatcccagcactttgggaggccaaggtgggcggatcacctgaggtcaggagtttgaaaccagcctggtcaacatagtgaaaccccatctctactaaaaatacaaaaaaattagttgggtgtggtggcatataattgctgtaatcccagctactcgagaggctgaggcaggagaatcgcttgaacctgggaggcagaggttgcagtgagccgagattgcatcattgcagttcagctgggcgacaagagcaagactctgtctcaaaaaaaaaaaaaaaaaaaaaaaaaattcagatgtccagcttttcatgaaaaaatccaaagttctggtcacacgctggacaacaatagccataggtgagcacctgctgccctgggaacaggcacgtgccctccaggtggtgaatgacccacttctctcaccagcttcaattgtgtccatctaggacatttggaactcttccaggctgctgcactcaccaatggcaccttcctggcctcatgggcatttgagtttgtactcctggccaggacctaatgctgcagaccagataacttcctgggttcttgccctaaaggaggagctgaagccataagcgcagacctctaatgtggctcagagacactgtggagagagggcagtccaggcccagggtcttgacggtcccgcccctggacttattaggccccctctgcatagctcatagtggcagtgataccagacgtcacctaaaccttcccactcctgcggcacccactaccattcagcctcagggccatcctaaccttaactccaggctcctctctcacatgggactattccagctctgactttagctcccatgaagaactggctcccgagtcctggctccccatccaggacccaggttccagtcctctcaatgggctctccctgatagaggtcaccttgggtctggtggcctaccccatttcttacaacatacaccccacaccagccttgggccagccacctcctttgtgccccagaatggctgtcagggaagaccctgcctgtgtgccccaacctgtgggcaaggcaaggcctagggctctgcccaccaggaataacagacccagctagggaaaggcaggctttgagatgcacgtgtgatgttgaccctccccccgggtcaccccaatacccgtctgcctgattctctgttgccccacagggtcccagagagtgctgagctgcacatttgacaggctatgtgcccatgggtccaatgtgtccatggatgacctgaattccaaggccatcaggaaaagcctattgtgttgggcccccaggaagccaagccaggctggctaccctgggatcttcagaggagagcagcctagcttgtacagatcccctccatgggccaggccctagaaatttcacacaaaaaaattatccttttttacagcaactcatgagagagaccatgaggataccattttacagatgagaaaactgagagtgaaggaggtgatgcaaccaatgagtgacagaacatggacatgaaacatgtcttggcaactccagtacccaagatttctccatgtcagctgtcagcctgcctggctcacaaaaccttcatccccagtgtagaaaggactgatagacaagttaggggcttctctctcacagggcccttgtgtgtgcccacccttcacacacatacacccattcacacatacatacatacatctgcacacacaaacacctatggggtccacacacatgcacacaaatacacgcacaaacaccctgcatatccacacatacacacaggcatattcacacatatatacgtgcacctgcatacaaacacacacatagacacaaacacccataaatatccacacacacacaaacatgcacatacacacaaatactcatacacaaacaccctacatgttcacacatacaaactcctgcactcacacaaacaccttccatatccacacatccatacatatatattcacacacacacacacacgcatgctcacacacacgagcagagcactggaccaggagcaggagctgggactctcgtcccagatctcccatcacacttctcaagccttggcttcctcatctgtgagatggggttgtgccgcctgcttcccagagtgttgcacaagcaaacatgcatgacagcccaggaagtgagaagggtgtataggaggaaagggtcctgatttttggcagaagttgcccagggagtagtgagtgctccacacctttgtatgtgctgtaccttctctctggagctcttttctcttcttctctggctggtgaactcatcctcaccttccagctccaacaaccacactttgtgttcctgatgtctccctgtagtggaattcctccaccatcctcagtgtccccagctcctgtgtgagacaggacttcctacactggagtgggacacgtgaatgaggctgcatggctcttcggagccggatgagtcccgacttctcctgccacaacccaagtcccttcacagacccacagcacagtctctcagaggtatcttttaaggccagaccctggccttccctttgacagcactgatgcaaagctcctgatgtgactaggagtttaagaaccccctaagtgcccctagctgcctggtatagacctgccagcctctgcccatcctgcttcatctgctctgaccttttgctctctggtggagtccttgccatgatggcctgggcccagtctggtctggcctagggaggcgcttttctgcccaggcatcagggcctgtcctcacgcagagttcagaacacacagaggcaccccatcactctcgaggtaggcctcacacctcgcaagtcagcctcaaaaaagcaagtatgaggcaggatcccctttctggctttgggtaggggctgcagttcctcttgccatgtggaagcttcttaaatattgtactacaatatttaaaaatattccctttgttctacataccattaatagatcaactcttctacagctctgcaatcacttctgacttggcaaagctgagcctgagctcagggaagggctctggcttcagccttgtgaagcagaaagatcgtggactctcgcacaggacccctgtttacatttctctcaagcacagcctcaccttctcagtcctgctccaaaaacaccacacaacttccagttctgagaatgcaccctgttctctcagccctgggctttccacatgctaaccccttctcagaacctcccttccttcacttcgatacctaactgatttctattctccttcaaaaccccattctaacatcacctcttctgggaagcttctctgacttctctgaggccctcccaggctatcatttccttcctgataatggctccttatagcactggccacttatatggaagtggtgcatttgagtctctcccactgcaccatgggttttcaatggaagagtgtgtgtatcattcctctttgtaatcccagctctgtcatcacaagatggaattcaagcatgtacctggtagttgatcaagctctatattcatagagcccaaacccaaacctaaaccaagaagaaagaagaaaataatagaggctagtctagaaataacatagaccaggctaattccttaataataaagacaatagagaaaatacttccccaacccttgctaatgccaatgggaaaaaaatagagaaatctttaaaaaccaaaattggttatttgaaaagattaacaaaattggcaaatctttaactatactgaccagaaaaaagaaagattaaaatcagaaatgaaaaagaagatattacctctaaccttcaaaaataaaaaattataagtgaatgctatgaacaattatatgtcaataaattaaatgacttagatgaactggagaaattcctagaaaaacacagaaaccaaacctgactaaagaagaaatagaaagtctaaagaaacctttaacaactaaagagatgaaattagtaatccaacaactaactgcaaaaagaaagccaagccccaatggcttcattggtgaaattaaacatttaaagaataatttgcgttttaaaaatatttgcatttaaaggagcttttaaagaaaaattattatcaattcttcacaaacttgcaaaaagttaggcataaacacttcccaactcattctatggggccattactattctgatactgaaattagacaaagacatcacaaaaaaagaacactactaatacctcttatgaatatggatacaataataacaaaatactagcaaactaaattcagcaacatataaaaaggattatacacaatgatcaagtgcagtttgtcccaggaatgcagggttggtttaacatccaaaaaatcatcaacgtaataccatattattaattgttctattaatactatattaatagaataaaagatcaaaacctcataatcatctcaatagatacagaaaaaaatgacaaaatacaaaactccttcatagtaaaaacactcagaaagaataaaagagaatttcctcaacctaataaagcgtatatactaaaaaagcagcaacaacaaaaaaaacatagataacatcacatttaatgggaaagacaacatgctttccttctaagatcacaaaagaaacaaggatgtctactcaccacttccattcaacatcatactgaaggttccaactattgcaattatataagggaaaaaaaggcacccagataggaaagaaagatgtaaaatggtctcaattggcagatgacacgatttttctatgtagaaaatcctaagcaattcacaaaaaaattaaaatatgtaaatgaattcagcaagattttagcacatgagatcagtttgcaaaaatcaattctgtttctatacactgtcaatgaacaagacaaaaatgaaattagaaaaataattccatttacaataacatcaaaaaatacttaggaataaagataacaaaagaaatccaaatggtatattccgaaaaatataaaacattgttgaaagaggtcttaaaagatcaaaataaatgaaaatacatatcatgtttttggaccagaagacttattgttaaagatagaaatatcccagagttaatctataagttcaatgcaatctctatcaaaatcccagatgacttctttgcagaaattgacaaggcaatcctcaaatttatatggaaaatcaaggaatgcagaatagccaaaataatcttgaaaaaagaaaaacgaagctggagtactcacgttttccacattcaaaacttactagaaagctacagtaatctaaacagtgtgatactagcataagaacagatcaataaaatagaactgagagtccagaaataaatccatgatctatctacatacatctattgtcaattaactttttttttgagatggaggcttgctctatggcccaggctggagtgcagtggtgctatctcagctcactgcaacctccacctccctggctcaagcaattctcttgcctcagcctcctaagtagctggaattacagacacacaccaccacacctggctaatttttgtatttttagtagatacggggttttgccatgttgcccagctggtctcaaactcctgagctaaaagtgatccgcctgccttggcctcccaaaatgctgggattacatgcatgtgagccaccaggcccaactgtattgtcaattaatttttaacaagagtgccaagaccattcaatgggggaaataataatcaaataatctcttcaacaaatggtgctggaacaactggatatccacatgcaaaagaatgaagttggactcccatcttacaccatatagaaaaattaacttaaagcgggtcaacaacctacatataagagctaaagccataaaactcttagaagaaaacataggagtatatcttcataattttagctttagcaatagagtcttagatatgataccagaagcatgaacaacaaaagaagaactagataaattagacttcataaaaatagtaaactttcgaacatcaaagaaaattaccaacaaagtaaaatcatacatctaataaaggtctggtatccaaagcatttaaagaactcttacagctcatcagcaaaaacacacaactcaattttaaaatgggcaaagacttgaatagacatttctccaaagaaaatatacaaatgccaacaagcacatgaaaagacactcaatatttttattaattagggaaatgcaaatcaaaattgcaatgaggtaccaattcacacccactgtatatatatgtaataggtggatggatatatataatatttatatataattatttataatatgtatatataataatgttattatatgataaattatataatacatatataatttattgatttgagacaggctcttgccatgttatccaggctggagtgcagtgacaccatcacagctcacagtggcctgaacctcccaggatcaagtgatcctccacctcagcttcctgagcagctaagaggtactacaggcaggcataaccatgccctactaatttcttaatttttttgtagagacaggatctcactatgttgcccaggctggtctcaaattcctggcctcaagctatcctcccaaagtgctggcattagaggcatgagccactgcacctgacttaggatggatatatttttttcaatggaaaataacaagggctaacaagaatgtagaaaaattggaaccctcagacattgttggtgagaatgtaaaatggcacaactgctgagaaaagtttggtgatttctcaaaaacttaaatatagaattatggtatgatcaagcaattccactcctaggtatatacccagaagaactgacactgactactcaaacaagtacatgtatctttatagcagcactatgaacaatagccaaaaggtggaaacaacccaaatttccataacaaatgaatggataaacaaattgtgatatacaatggaataatagccataaaaaggaatgatgtactgatacatgctggaacatggatgagctaccaatttacaggaaacacagaggacaggggacatgttgaatagcaccatgagagtgcagtcagcaaaatccagactattggaaactctacagatcaaatgacctgggtcttgggagggggtaggaaaacctgtgtattaaccaacttttaaaagatgtatttttataaaataagtgagatttaattatagggtgtagggatatacatgtgggtaataattagactatgaagcaaaggaaaggagtgtctactgtaagtcaaggtagtggtgactttggagaagagagtgaggaggtgcctctggacaaagttctgtttcttagtctaggtggtggttacaaagctttactcttgtaaaaatccattaagccatgcatttgttttatgtggcttcttatagctttgtttatttgcaaataataacctggttcagagattctgattcacagggtgtggggcagagttcaggaatgcttttaaattttcccgtgttgtgtgcgcacacacacacacgcatacatatatatctgtcttccacaccaggctggtgcctgtttgaggaaggtctgtggcttgcctcaatttggacttcccaacctccagaactataagaaataaatttctgttctttatgaattacccagcctcaggtattcttttatagcaacacaaaacaaaccaagacagcttctatctctctcctactgacctatgagcagggcatgctttgtttctgtctttgcattcagcacctagcacacagtaagtgctctgtaaatgctgatgaggctgggctgatacacaggtggactgacagtgggcataccagacaagatccagtggcccctgaagcagtcaactcacccacagcaatgctggagggctatgaacttcccaatctcactgaggaccacaggagcattccacctctactgggcagtaaaatccagaacgccggctgcagacattccacttagagtcatgccaacatcctctctgggccccactagcttaagacagagccacagacacaggcgtccagaattaagagtccatctcagccctgaggctgatttctcactacacactgaccctgagaaaaacttcagggactgcaaaaggcagccagaaacactgggagaagggagggaagaaagcgcctctgaaatagacagaaacactaatgcaccaccagtgcctctttcagacataagccagtccagctccccatgggcaggcccaggatcacacaggacactacaaaccaggtctctgcccaagaaccaggctgtaggggccaccagagcctcactggaacaggttaatgcagaatacagtcatgtacgtccaaacggagctacaggccttccccgttaaagacagtgccctccccggggtagaaaggaaaacaatactccttatcagcatgaccattgtatgttaagtcttgtgatgcatgtttgcaagttactccaagtaactatggatcttgtccccaactcaggccagccagctgacaggccctgaagtcagcagctacagttggctgattctgaacccagtgatgcctgctgtttgcagggaatgagatacttacttaattatctcaaatttaaacactcttatatgtttccttaatttaaaaaccatacacacacagaagtgaggacatctaaaaatgggatctgcgttactgatgtgtaagccagaaaaaaagaggagttctcaaatacactctgagctggacttcacagctacgccagttcctcaagtggttcgtggaggtgagcggcagatgcaggccagtcttagaatgtgaaaaatctgagagctataagacaattcaaaaacagacaataagtcaaatcccattgaattgtgttattttaaatataaagaaagaaatgtacaaacatttaacagaaaattagattccccctgtccccacaaatcaaatccaaaattacccatgtgaaaacttcacggcattatccactttccaccaaggcctccacgtgctcgttctctggccaggccttggtagtgtggactggtcaccatgtaaggacagccttctgtgagctgcagaccaagggaggtggcctggcagcctgttggaggccaggcaaggataaaatttactatcaatccttttttttttttttttgagatggagtcttgctctgttgcccaggctggagtgcagtggtgtgatctcggctcactgcaacctctgcctcctgggtcaagcaattctcctgcctcagcctcccaagtagctgggactacaggtgcatgccaccacacccagctaatttttgtgtatttttagtagagacagggtttcaccatgttggccaggatggtctcaatctcttgacctcgtgatctgcccaccttggcctcccaaagtgctgggattacaggcatgagccaccatgcccagccatcaatccctttttatgtataagaaataggctcagagaggccagatggcatggcccagtttgcacagtaaggtgattgcctgtcacggccaaatagccaccacgtccggataatccatggccactggtttctgtgaggtggtggagaggcggcctcagcctgagccctctggatcgtgggcaacgggtggtgtgaggaaactgtccagcagtgatctactgtccctgcactcccacactgcagggccaggggtgcatctgcatcccacgcggggaatgcctgggcatgaggcttcaagaagcacttagcaggaatgcaccgggtgctcagaggagccgctgtcctggcaggctttgctgtccacatttgcccctttgcacggagcctgctgtccctgaagtgctctgacctgtccacaggaaaccaggtcaggcacaaaataaccacccttgtctcaaagcaagggccctaatgcctccattccttcaatgccttttccttcagccaaggtcccctgcagtcttgtcctgggcactgaactgggtgctggggatgggctggattatgaggaaggaaggtctctgctctcaagaagaagtgggtcccccatcctagggcagaaggcactgccatcctgagtcagcttatcgcagctcagatttcactccctctgtgctgggccctgggaatggggagatgacactgccatggccctgccctcaggggctccccatcacgtggggaagccagacacaaaggtaaatttgggaggaagcccccaatgcctcataagctatcaaaaaccagagtccacagcaatgggaaaaacaaggcaaggaaggtaacctgcaaagaaacgagggctggggaggcaacacgcaaacagccagaggagactgtgaggaggccccccacagactcatcacctcaaagcggagccccaggaatgaacagtcagctctaggacgtgctaaatgccccaggagaggcacgaaccaggggaccactgacaccactcggccttcggaggtgagaggcggcttcccagaggagggcatattggctgagcaggatttcctcaggtagacacagggggaaaccaagcatcgcaactgaaggccaggtaacacagatctgccgaaagagacatcatgattttcaaacaagcaaacgaaagggattcattctattctgcaactgtcaggcatactcagaccaagagtaatctttcaaataaaccccagaaaatgaaatcacgtatgccatgttctagccccgcagtggaaagtggtttagcctctggtcccggagtcttgcctgtctcttctcccacccacctcccctgcctctctccccttcccagctgcccagaaggtgactaactgcatgtccacttttttttctgctgattcttcccatttctgatattaagtagcactttctctgcaagcaaagctacactgatataatacagatgaaactgggaaagtccaggctaaatttcaggatacgtatacagaaatgcgttgagatacagcacctcactcagcaaccatgccttatagatagtgctaagcttcagtcgcatcacagaactttctaccctgcatgagttctctgacctggctgtgagcttcttgtgggtggggtctcagtcattcccaagcagccagatgtgtctcagtgcctggcatacagaaggcatatgataaatgtttgctgaatgagtaattcacaagtaggtccattgttataaatgaatgttttggaaacacaagctgtcactgagttccacgtgtcgtgttctgctttcgaatgacctgccctgaatatatctcacatgcagtcttgcatatgcctgattcagacttttgctcacagctacggggaggtgttgagctctgcatgggccagcagatccaggcagaaagacttccatgtctgtacagcagcatttgttcattgctccaatggtttattttcccctggttttattaaaatagtgaaaaacactaaagtggaagggcttacactcaagagcaacacaattggaatgacagcatgggttttcaggggtgcccaaagaagtccttcccctctgttgtatgtccctaggtcttaagccactacactgaattcatgtgtgaaggaaaggaacaaaattcaagggtgtgtatgaaatgctagcaatatagccttgaatgctgtacctggatgtagagcaggaagcaaggcttgtaccgtctcttccttacctctctgagaagggaccccaccccaaattgatctgctctggctccgacacaccccctacatacgacccactctgtggaggcaatagggaagtcctgctctgtgtctgaaaatgtcaaagacagcttattcctgggaagccatcaaatacgccctgctctgctgtatatattattcaagtactcagtaaaccctttgtttctggagagcaaaggccactggcagcccaacctctgcccagacaaggaggggacaggcagggagctggcaagggcacacaggatcatggccagagggtgagctcagtgcccagaatctgtccccataggagcacagggtccccaggctttcaattctccagacttcgtttcccagcctataaaatgcgtacaaaactgacatcctctcgggatgttaagattcgatgatattacaaatgtgaaagcactttggaacccataaactgctgtatcaatactggttgatcgtgctcttattaagattattctattaataacccatctcaaattacatatctgtagacagtgcgtttgtgcatctattgggccagctgctctccaggccgggaagccagaaagatctcatggaggagctggtcctcctacttccttcccttgctaaggccaaacctgcccgaatgagcttcatctagagggcacctctcaggctcagcacctggagcagccctccatgtggacagccgggcctgtccagcccaaccagagggggccgtggattttgtccatggctgtttcccagactccatggcagtgatttagatgcccctgccccctggccgcacgctggaacatgtgcacctggtttctcccggcactgacctacttatccatcagttactcaactgtctactgacgtgtttattgagcatgtcccaaaggccaggtaccagaccacttgctgcatgtgacatgcagacacatatggaaccaggccagcccttgaacaatcacgacaagtgtcccaagtgctacaaaagagaaggaagggatgatgttgcagaaagtggggagggaggggcagtgctaacctgctctggggtctctctcgaaatttccttttgtttgtcctgctgacctttctatgcatgcttttactctgaagtcacaccttttcttaacctgtagaaaattctcggtcatgtcattctaccactccttctactgtatcttctctaccattctctccacattttctccttcagaacattggttgttaaaactcagccattttttaagttctcttccatagtttcatctccttctatctgtgagctgcttttagttttccattcgcaaattgtatctttgactagctcatctattgatttaattatcatagtttttatacctagatttctactcagttttttttcagagccaatctgttcttaatttataccttcctgggtttattttataattactttttatgaatgctatttcttcttctttgtgggtcttaagatgcttaaggctttttggttttgagatttttctcatatttccatttatttggcagtgaattcatctcctattattagttttgtaacctttcttagaattagttttttcacatgcttcaaaatgttcgcttgcaataggaattctgtgttttgttcttcccactgcattaacctcccagacccacccgcaccctcccaggattttgtcattgctcccatctggccttctagagtacccagtcccaaatgaggcttgctctgacagctccgaggttctgaaatgccaaaacggaggagttagccagtccagtcattggcccagggcctggcccaggaactacctttgagcctccctttgcccccttttgccctcttaggcatgcaggtcttgctagccttagccctggtagcagttccagtattttgcagccacctgtcacaggtggctggatctgccctcgctcccagttcccatagcccctgacgcaagtgagatgctttgggctctcaggtcctttgcccatgtcagagcccagaggtgtggtctcactatgctgtggaaccccagctgacagaaccactcactgcccagggatcctcagggaggttgagaagggaaagcagattgctttaaaggccgccgttataaagccatagccaaagcagctgtggcctgtgaaatggacctacgagaaacacagcaagagagaaggtgtgaaaaccaggagcgcctctcagtccctgcatgaggaagcaatgtgactgtttgatggccctgagttatgtgggggtcatacaggccccttagctatatcatcattccaacagcacaaagacatgaaaaaacctacagtttgcaagcagctgccccagagacagactggcaacaccatgaggccaaatcatacaattgcacagagaaggcagcccttctgtgtgcctgtgcagccttcctccctcaactggcattgcacctagggcaggccctatgtccaaagtgagcagtgatatcagggttacttgcccaggtcactgaccagtaaacgacatgtatgtgtcaccggtcagttgctattggtataaacacttcttctgtaatatatatggcctagtatccatttgggatggttccaaaccataagttggggttctccaggtttggaatggtgcatttcagaaggtaaaaataccagaaattagactacaagaaaatgatgtgttagagaggagtgtggggtaaggagactaacagcagagaggcaggcaagattcaacattttgagatttattttgtgttattggcaagccttcataggctttttagcagggtactaacaaggaaatatttaggaagaaaactggtagccacatggatgagctgttggagagaaagagactagagacagtgtctggagtcaggccagccccaggttccagttttatactcctctgtaggtgcttttgttccaaccttggtccagattcactcctaaattcatcagggtttccactccttgaagtcaaagaggtctaatgaacacagcactttatgcatattacctttctcagccatcaaatcattacaaattagaacttggaactggagagagcaagttacttgcctaaggacacagctattagacaggtgtatgggcttcccaagtgatgcaccaatcctccctctccccaagcaggatgcagagggcagcaagggaggggttccaaatgggtgatgtggtgctctcgcagcaacccaaggctcaggttcagctctagccctcagtactgagctaaaactggccaggtgcagtggctcatgcttgtaatcccgtcactttgggaggccgagttgggcagatcacttaaaggtcaggaatttgagaccagcctggccaacatggtaaaaccccatctctactaaaaatacaaaaaaaaaattagccaggtgtggtggtgtgcacccatagtcccagctactcaggaggctgaggtgggagaattgcttgaacctgggaggcggaggttgcagtgagccaagatcacaccactgcactccagcctaggcaacaaagtgagaccttgtctcaaaaaaaaaaaaaaaaaaaaaaagaaaagaaaataaaaagaaaaaagacagtactgagctaaaactgaagacagttagggaggccctggtcatcctctcaccccttctcccttcatgtccattcacccccagccccaagcccagccagtggtcactggggccacacgtccccatctttgtgctttgcacatgggtcctctgacccagctgcctcccacctggatctgcctgaagaactcttcaatatacagcttctgttatcagacgctcatttcggggggacagctgccacaagtgtggcctctgcagccagagatccaagttcaaatcctgattctgcctctagtgagctgtgtgatcacagtcaagttatttcacttctctgaatctcagcttttcatctgcaaaagctgtcccaaggtcattttaataaatgcatacaatagctgctgcgaagcgctcagtattgctgagaactactggcgtctataaagttctgagtcagggttaacagctgtggcatgtatggtaattgtttgcttgcgaatcatccttcccctcagctgcctgtgagttcctcagggagaggagccatctttgattcagggctatgttccagtgcctgaaataaggcatacctcggaaatgcttgttaaacaaaggaaggaacgtgagagtgaatgatgacaactctctttgccaaacattctaccagtgactcctttgcgaaaactggctgcaggatggtgattttgatttgctgtaaacctagtgccaattgcttccatctgagctttagataggtgaagagcctcccctcgccccgggagtgtcacatctatagccagggcaccgtggataatccattaacacggattccctctctgcagcctcaatgaccctgtcagttcccagctgctaagaggttgcctcagccatgacctgggaccatgaccatcatacctgattcacctggacctcccacttggacaccctacctggacaccccacctgggaatcctacctggacatcccacctggacattccacctggacatcccacctggacatcccacctgaacatcacagcttttgccttcctggcttcagaaaacctaaagccaagcctggccacaccctgggagtagcagagctttggcctcacagaagcagcagatgtggagccaaactttactgtggcctgaggacctggctttgaacctagctctgctaactgactttatcaccttgggcaacttacttagcctttggggacttgatgtccatttatctaaaatggaaatagtgctagctatcgcttcttgagcactcatcaaattgacagggaaaggcctcattgttatttctattcagcatcgccttctcaggagcatgggtccaggtttctggaggatacctgaggaccaggagccctgatgtgtgggccgcacgcccacgtccctgcccagacaggcctcccctcacattgcaatttcagtccttggctgaaattcagtcccttggctattatactgctcccaggtggggaggagttgagagttagagacaggaaagaccaagaagaggaaggtgggagaagactcctctctgtgtttataaaaatgcttttggatgcctgctagcatcagaaagattttagctgccaattaacaaacagtggccacagctgaaggtgacaagatgttccttgcatcttaagctgatgctactgtttgcaagacatgagccttacattatgtcaaaaggtgtttactgaatgaatggatgaatggatccatcagctcacaggattaattaagattttcatcatctgaatgtgaaattatgtccatgtgcagagcctccattcctgcccagcggcttcatcacagccaggtccctgtctctcctgggtcccctcaatggctctccttcctcccaggtgtctggggaaggacagcagcagtaatccagggacagcctttatagcggatgaagcactctgccagacaccgctgccctatctctataggattctcatctccactgggagaaaaatacttactattataagctgcctcaaattatttccaacaccactaaggaactcatggtaaaatataaactcaataaagagctgggtatggctcttaccctgaggatagggtgcagctgcgagctgactgttctgagctctgccttagaacagagtggcagtgtttcctagtgcccaggtgactctctctgctgggcctgctgtggctcagccctagatccaacaaagagagggcaggagcacagcctaggccttcttctggcatcccagctcactgtgggttgcaactcaccagtgggtgtgaaatccatcacgactgagaccagtaagtttttaatgaaatgaaatacaaaaaaaaaaaaagttagagtttgtatatgcgtgcatactgtgtcacaccgtaatttgttttttttttgttgttgttttttaattttattattattatactttaagttttaggatacatgtgcacaacgtgcaggtttgttacatatgtatacatgtgccatgttggtgtgctgcacccattaactcgtcatttagcattaggtatatctcctaatgctatccctccccccaccccacagcagtccccagtgtgtgatgttccccttcctgtgtccaactgttcgcactgttcaattcccacctatgagtgagaacatgcggtgtttggttttttgtccttgcaatagtttgctgagaatgatggtttccagcttcatccatgtccctacaaaggacatgaactcatcattttttatggctgcatagtatcccatggtgtatatgtgccacattttcttaatccagtctatcattgttgtacatttgggttggttccaagtctttgctattgtgaatagtgccgcaataagcatacatgtgcatgtgtctttatagcagcatgatttataatcctttgggtatatagccagtaatgggatggctgggtcaaatggtatttccagttctagattcctgaggaatcgccacactgacttccacaagggttgaactagtttacagtcccaccaacagtgtaaaagtgttcctatttctccacaacctctccagcacctgttgtctcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatatccttcgcccactttttgatggggttgtttgttttttcttgtaaatttgtttgagtcataatttgttttttgttgttgttttgctattttttgagacagagtctctgttgcccaggctggagtgcaatggcacaatctcagctcactgcaacttctgcctcccaggttcaagtgattgtcctgcctcagtcacccgagtagctgggattagaggcacccaccaccacacccagctaatttttgtatttttagtggagatggggtttcaccatgttggtgagacgagtctcaaactcctgacctcaggtgatccacccgcctcagcctcccaaagtgctgggattacaggcgtgagccgccatgcctgacaggtaatttgtatttctaactgtagattgtagtcaaagtttgaacgggtcagccatgcgcacaatgccagcctgcctacaaatgtagactggggcctttgactcatgcctgtaatcacaatattttgggatgtcgaggcaggcagatcacctgaggtcaggagttcaagaccagtctggccaacatggtgaaaccccatctctactaaaagtacacaaattagctggatgtgttggtccacaccagtaatcccagctactcaaaggctgaggcacaagaatcacttgaacccgggaggtggaggttgcagtgaatcaagatcatgccattgcactgcagcctgggcgacagtgtgagactctgtcccaaaaaaaagaaaaaaaaagagtaggttgggaagccagtaactaggaacaggctccatttaatccatcacaaaaagaggatttgagcagagaaggcaaagacaaacccttgggcaggcagcatctgctctgctggacaagctgttttcaaccatacctaatgatggaagcagggactacattgtccaaagcaaggatcttgggacccagtgggggctcaacgcagcaaagggctgctgatatgctcatctaagatcctgatgggtgcccgtttcttacagaactgtgtgctcacagctgtgctcagtgggccacatggtcctgcccgtctggccagcccatcttggttccactgtgttcctggagtccttactgctaggctctggctgatgctagcccctgtgatgggctgcccgccccacatttcccctggctggtctccactctctcggctactccctgctctgtcccataaaagcactcaaggcagccttctcatctagatcattctttaggcctggagttctttaatctgagggcttttgcacaccctgaattggatgcaaaagggggtatttgtcccatgtgtgtttttctgggaaaaggactcacaattttaccagactctcaaaagcatctgtgccctcagcaaaagccccaagccctgcctcaggaagcctgatctgctcaggctgggtgactatctgtccgtgtctgtcccccccaaagtggcgttcagcaactgatgctggggcaaactgccctgccatctgccagaatgtaaagcatcagctgtgtggaggatgggcggggggctggaccccagccaggccctttcaaaggcactaggggtttggctctagcatgcatccctgttgtgggtggcaaaaaccactaccgggagtcaggctgagctggcttaaatcccagttctgtctctggctcattctgcctccataggcacctgtttaacctctgtgaggctctgatttctcatctagaaaatgccgataagaagatgtaccttccaggattattgtggcaattaaatgagatactgtaagaacagccactttaccgcctataaatgctattttttttaattgactcagtgaaaaacattttaccattttaaataccctcaacccctgaagcactgcagctcttagctctatgacctcaggaaaattacttatttctgtcaactgtcctacttctgacaaatggggatggcttcatgttggtgttcgcaagatgacaagtcaacacgtaggaagcacttgaagcagggcctgggtccttgtacagtcttgcactgttatttctgcaagaaaggagtggcaggtgaagagtccctcccttagactgtgcctaggagcaaaattgccatttctgtctgtcttagtccattttttgttgctataaaggaatacctgaggctgaatactttataaacaaaggaggtttctttggctcacagttctgctgggtggaaggttcaagactgggcctctggtgagggcctcaggctgcttccactcatggcagaaggtgagggggagccggtgtgtgtagagattgcatggtgagagaggaaacaagagggaaagagagtggtgcctagctctttaacaccagctctcacaggagctaatagagtgagaactcactcactacctctaggacagcaccaagccattcatgaggaacttggccccatgacccaagcacctctcaattaggccccacctccaacagtagggttcagttgttcttcctgcctcctgagatggagtcttgctctgtcgccaggctggagtgcagtggcgtgatcttggctcactgtaacctccgcctcccgggttcaagcgattcttctgcctcagcctcccgagtagctgggactacaggcatgtgctaccacggctggctaatttttgtattttcagtagagacggggtttcaccatgttggccaggatggcctcgatcttctgacctcgtgatccgcccacctcagcctcccaaagtcctgggattacagacataagctattgcgcctggcctaggggttcacatttcaacatgaggtttgaggggacagacattcaaactatagcactctctctccttgcctctccttgccgatgggccaccagaaatctctcttcccttcttcaccaaacactgctccacctagacagtggtgcagttgccagaaggcacatgttgcctagcacagaacctcccattctgtccgttttattggcactgtgggctcaaatgctaatgaaacacatggcaagacctcgaattcagtccccatttggttggtgaggaagaggccctactcactgactttgcattcatcacctctgaccccatcacgacctctgagacagagccaagaagcccattttatagatgaagaaaccaagcctgagtggggtaagcacttgcccaaggttacacagctggcaaagggcagtgaggtctgcctagacctcacttgctcctccatgccatgaagctctcttattcacctctttgttagcaaatgtcttaaaagcatttgaagtgcctgaaatgtcaaaatccagctggcatccccattagggagggctcatccactgagtggacagattatggtgacaggtacctgccccggtcttcccacacaccccagcaaggggtcatatgtactctcttccacagattgcacctcccgagttttctctctctcacacctcccttctcaccaccatacccttgacccagtaatttctcagaccctacatgtctccaccagcccacgtgcccattagactcaaggagaggaaacggcagaggttcaacctagcaagcccaagctctgggttttctggctttccctgagtgattgtggcagggggtgggtcactgaaggttatcagcatatcactggcttgaccctgggtgggaggcagggagggcttcccgctttgaggcgccccacccccacccctgtgaacagggtaattatggatagactgggctgagtgatggcctggggtctcgggcatctgcaggctgcccccaggctgaagcatgcctgccagtggcttttaggcccatatgagctggagggtccttccttccttcccaggctcacagaacccctgtggggctgctgtgagtcctgtgaggccacccactaagctgccaccccagccaggcagccttggtaggaacagcccagaccaaagggagattggagccaggaaattccacggtggtgggactggcctgctgtatgcacagattcaggctctaggaggccctgggaagggaagggccctgcccacacccacagtccctcagggcaccccctggctaggcttgtgtttcccccctaagaagacctttacagagcccaggctggagtcctggacgtgggtgcaggaagggaactcagagcttccaggcggggctggcagccacacctctgctgctcctctgccaggccctggcatggcagagccagcctgggcggggaacggcaagaggagcaggaagcagagagagggtttctgtgggggtgtaaccgcccaaggggttctcctcacctgctgcccagatagccgatttatcatgacaggagaattgtaatagagaaagactaattcatgcagagccagctgtatgagagaccagagttttatgattactcaaatttttaagtctccctgaaaattctgagactcaggtttttaaggataatttggtgggtagggagtcggaaagtggggagtgctgattggtggagtcagaaataaaatcatagagtgtcaaagtgggattattttgctgtcttcattcggttcctgggtggcatcgcagaactggttgagccagagtaccggtctgggtgcctgctggtgcattggaacacagggtctgcaaaatagctctagcattaatctgagtttttacaacagtgacgttagccccaggagcagtttggggaggttccaaatcttgcagcccctggctgcgtgactcctaaaccgtaatttctaatattgtgactaatttgttagtccttcaaaggcagactggtccccaggcaagaagccaagaagcggggttgtttcaggaaagggctcttatcatttttgttgcaaagtaaaactataaactaaatttctcccaaaattagttctacctacccccaggaatgaacaaggatcgcttggaggttagaagcaagatggagtccgttaggtcggatctctttcactgccatcattttctcactgttataatttttgcaaagtcattttcagggggaggaggagtttcagtgctggggcttggaatggcctggcatcctgccccaaggagcccaggaacccacctcgggctgcaatgggatcagagctggttcaggggtaagggtcatgtccagaacaccctgggactggcatggaaagccctggaggaatggcagcaagggccatgcgtcagaggcccatatctggccacccattttactcaacatggggccagagtcctgagggcagtgacttgctaagaccacacagaaagaatgggggtgagtgggaggagtagtgtcttccagattgagcctgcggaccagaggcagcctgagggtgtgaaagggccgtggccaaagagcactaaccctgctcaaaggtggccctctttgggccgggtctcaccagcagccagtgagcgctgtggtttccaagcaagctattcggagtgcaagccgtctgaggaggccccacatccaaacacagacacaggcatgagcgcgtgtgtgcattcacacacacacatgagcacgcccatgcacaccccgcaccatgcacacacacatacacacatttcaaccagaagaatttctcttttctctcttctgtatcagattttgatgactgaagccaataaaattgcttttttaaaaaggcagtggccacagaagaatgggcacctttgggagtcagaagccactgcaactccatgtcagggcacttacagctctaagattgctgaggtcaggaagtggcgagccgggttcacataccacacacataactcacaccctctatactacacataccccacacacaaacacacatcacacacacaaccacacacaatacatacaccccacacacacacatcacacacacagccacacatatcacacacaaccacacacatcacatacacataattgcacatgatacacacaccccacacacaaacacacacatcgcacacacaaccacacatgccacacacacaaccacacacatcgcatacacacaatcacacacaatacacataccccacatacaaacacacatatcacacaaccacacacctcacaccacatacacaccacatacatcacataccacacacaccacatataaccatacacatcacatacatcacacaactgcatacaaccacacacaatacacaaccacacatatcacatacatcacagtcacatacacacaaccacacaaaatacacacacccccacacaaacacacaaccacacatatcacacaaccacacacactacacaccacccatacaaccacacacatcgcatacacacaaccacacagaccacacacaaccacacacatcatacaaccacacacacaaccacacaaccacacacgacatgcacaccacacatataccacacaaaccacacagaaccatacacatcttattcatcacacatcaatcacacactacacacaaccacacacactacacacaccctacacacaaatccaaaaccacacacatcataaaaccacacataccacacaccacacaaccacacacatcacatacatacaacacacatataccacacacaccacatacaaccacacacatcacataatcgcatacaataacacactgcacacaaccatacacaatacacacactccacatacctcacacacaaattcacaaccacatacgtcacacacacaaccacacacaccacaaccacacacatcacattcatcatacatcacacaatcacacacaaccacacaccacacacagtgcacacaccccacacacatacacacaccccaaacagtacaccacacgtgaaacacatgccactcacataccctacacaatacaacacacacacaaaatacacacacagcatacacacatcacacacaccacataacacagcacgcactacacacctcacacaccacacataccacacacactctacataatacgtcacacataccacacaacacacacacttccacacaatataccacatacacaccgcacatacaccatactcacatgtgccacacacataccccacatgatatatcacataaacacacacacacttaatttggcatagtcagcaagataagtgagtacagtacctgcacgtgaaattggcatttggaagccccgggatgctcctggggacggaggactgcggggagaagacaatgtgactggggagcaccggccattggggaggagatggtgcgaccggggagaaccaggagtgtttggagggacaccccaagaaacgggtttccatgccctgtgtgatagcaaaggtgctccttagacccatcctgtgctcaatctaggactggagtgccagaaaccagacctaaaggcattggaagggaaatacagagatcctagcacaaggagtgaacagtgaggggaagaaggagcctccgaataggcctggagactggaattgccagcgttacacatttctaaattgtttttctgatgctctctctaagaggggaggcactatcactcttggataaaggcacagtgttacaatgtccttctgatggcacacttgcccaccttagctttaacctcacagaaggtgtgcttctgccaattgctatgcattgaccagcagtcatagtggagctgacaccaaggagctgttttctttgcctctgattccttctcaaaattgcaccaaatatttgccatggcttctggctggaagtaggaatgttgttctgaacaatattatggggtggcggtgagatggacttgagaggcatcccggactcatgactcatctctttccctgcatccccagaatcctgtcacattactcttaatggtccagaaaatacaaggactcctcgaaggatgaaagaagggatttggtgagcagaggaaactataacccacactgtgtgcagtggaggaccagtgagaaagtgtggggggcttatggagtgcttccagcagggaagaggcacgtagaaggagcagagggccctggagccacagcaggcaaacctcttgggaatatgagacaaaatactacacatacgaaaccacatttgttcattctccttgccagcagaattttacgaagcccctgactcagtggctgagtgcagccctccagaagaatgccctgaagatgataagcaggatagagcacaggctgccatctctcttgcctaaatcactacattttaagaaaaagataagttcaatgatcctagcttttgcctcttcttgtacataagacaatgttcaagaggattagagattatgcttctataatctataaccaggtgcacccaaacattgaggagattctgctctaatgtaacttctgagcacatgcaaaacctccactgccagtatagaagctgtgggctgccacattgctttggagcagtctagcagaagttctgtgaaaggctctcctgggttgcaatcctcagtgagacttctgaataaaactaactttaattatcgaaaagcctgatttttttctttcattgacaggaaccagagttgagattgttggctctgtcctccttcacccagcagcaggcaactttgggagcgggcacttgagtaggagtgtgaaggtagccccagaagcactggggacctcccatgcatagaacactaactactggcacactcagcccagtagaattctctccacctccccagccctggagacagccttcactgcttgcaggtaacaaagataatgctcactgaaggatctcagagaaccttaggtcaaagacaggtattcaaacaagacataaacaattgtgaaaaaagtcacaattgaataccagcaccaaggaaatagagttaattgaatgaagagattttatttatttatttatttatttatttatttatttttactttttgagatgaaatctctctctggcgcccaggctggagttcagtggcgcgatctcggctcactgcaacctctgtctcccgggttcaagcgattgtcctacctcagcctcccgagtagctgggattataggcgcagcaccaccatgcccggctaatttttgtatttgcagtagagacggggtttcaccatgttggccaggctggtctcaaactcctgatctcaagtgatctgcctgactcggcctcccaaagtgctgggattacaggcgtgatccactgtgcccagcctgaagaagagattttagaagaaggaaatatctcaagaggaatgaaagtatatcaagaacaagtgattatagaaatgaaataattagatcttggcaatgaaagatatgattgtcaaaataaactaaataacttaatgattaggattagtatcatgataacatacatagagaattagtgatgtagaagaacaaggcaagggatactccagaattcagtgcaaaaagatagaaaggctgctagtggtctaccagattccagtttcctcttctttcagagtacaaggctggactacatgcaggttgatatggccacgtggctaaattctgtccaatgaatgtgagtagggggtctgtgtgctgctgatgaactaagggcgtgccttctccctgctgtcctgcttcccactgcctatagccagctctgcaagcaggtgaggatggcacactagagatgtcagagaaatggaatggagggagatttgagcttgtcaatgtcaaataaaagataaaataaaagattagagatgaatgtctaatgaatgtctaaatttaaaacattttatttggaagcaagaattgcaaattggggcatacacacagagtgggtagtcttaggtctgttcaaagaacaaagaaaagatgggaggttttacaaaaaggataaatgttatgtatcatttgaaagaaagttattttgcattagtaaagttttggagagctggtggctctgactagtgagggatggtggtgggtagagtcacagcagattgttttagtagctgttagataaaactggtttcaggttacaacaggaagcttcagcagttgagcttgtgaaaaatgtaattcttggagcaggtgccatgtgcctcaagtaattttcccccccgggcccttcaatttggatttagtcaggtgtaataggaatggcccaatttgcataatcttctttcttatggctcccttttgatcaagatctttctccaaaaccattgctgatcaaccatactgtcttgggaaaagctgtctatcccatgaaaaacatcaatttctcattctggtgtgcagtttgaatgcctctggttatggcatcaggccttttggtgaactttctgtgtggcacatacatcagtcatgagacatgttccttaaaatttgtctactttcagctttagaaatagaacagttcatgttttggtaattttatgagggaaagttggattagaggaacccagaagaatttaggtctatactagtctataggtaaatagcaagaactcaaacacaatgtagagttatcatttattaagaggcatattataactttactttagaaacacaggttttaaaatttttaacattgatcacgtaagaacctcagatttaaaactttgagactgggaagccaaactgaggcagactttagattttgcttacagttttaaggttcctgtgccaggaaatgacaattttaatgtactcattgtaaggctggtaacccttgaagtcaggcattttgtgcattcttcaaatatgacattttagtcaaagccttggtaatataatcaattatattctgctatagaaagagaatggattttttttttttttttttttttttttttttttttttttagatgtggtctcgctctgtctcccaggctcactctcccaggaatgcagtggcatgatcttggctcactgcaatctctgcctctcaggttcaatcaattcctgtgcctcagcctcccgagtagctgggattacaagtgtgaaccacaatgatcagctaatttttgtatttttttttagtatagatggagttttgccatgttggccaggtgggtcttgagctcctgacctcaggtgatccgcccgccttggcctcccaaagtgctgggattacaggcacgagccattgtgccccgctgaagagaatggattttcattgcacttaggcaaataatcatattgccataagaatactcacaaatagtttttgaattctggaagaatcaagtaaggagaaaacaccaaatgcttttatctttgtttaaaaaagtatactttatcaaattgctgtaaattatagataaagagaaattttttccttaaatctggagaacaaaatatttaagacaagaatcaacaatgttttaaataaaagttataaaaatattatttttttttgagatagagtctcgtttggtcacccaggctgaagtgcagtggcatgatctcagctcattataacctccgcctcctgggttcaaactattctcctgcctcagcctcctgagtaactggaattacaggtgctcaccaccactgttcctctgttgcccaggccagagtgcagtggcacgatctcagctcactgcaagctctgcctcctgggttcacaccattctcctgcctcagcctcccaaataggtgggactacaggtgcccaccaccacgcctggctaattttttgtatttttagtagagatggggtttcactgtgttagccaggatggtcttgatctcctgacgtcgtgatccacccatctcggcctcccaaagtgctgggcgtgagccaccatgcctggccaaaaatatctttatcaattacttaattcatgtaattaatttttgtcctgattgatcttgattactagtttcatgaacccatcaatttatttagtagagatctggacatttttatttagtctattgatcttaaagttaacagaaacctgtatttaagagtatttattagaatcttttccattaatctgattgtaaatgtttttagagaagaattcaaaactgtggatgacaaaaacttagaatagccatagttaaaaatctgacgaaagtttataatcaacaaggaaatttcgttatttctattatatatagcattttaagataaccagaattatgactaagacatatttctataaatttgtttatacttttttctttttttctcatctgatatttttataaatttacagaattttcagaactttcatatcaacaacataccaataaatgcaactaaaagaagatctagtatcacttatcatttgacaatgttttttgtatgatttaccaaataacagtaatcatttaatatccccatctacaagatgagaggtatatctcttgagactttccagggaccaaattagaaaaatcccaaggttaattctaggtcatgaagacttaggttaggatttgattttggggaagtttgtcaatgatgtaaaaaacttaaaatatttgattgaaacagaatcacagatcactgaaaaataatagtcattcacttaactaaagcgatagttgaggtttcagaagcaatatagaaagttacatggatgtaaacaccttaacctttttcaatatcagtttttctaagtaatcaaaaacctaataaagacaacacaataaattatcttgataaaatggttttttttttttttggctcagtaaccaaaaagttaaaaagaaaatctgcagaatgactgtttctccttaccagaatctcactaatataacctggaagttgaacctaatgaaaaatatacttgattttaatcctacacaggaagaatatgtccaagattgtgagtatacactatattatagaagaatgtaaacaagaaaactagtaccttgagaaagaaaatacatggctcttagtaacagcatggaaaagcttcctggttacatggtacaattcagacatattgagaaaagccaagagtatagaatcaaattatactggaggaaaacattgcttttctaggcttttaagagaaacacttcagcatcagaccataatagcagaggtagaactggcgggaaaaaaaaaagatgtaagagttgacaaaaaaggttgaaggagagaattatcaccccagccaagcaaaaaatacaccttttcaaggggagaaagttcagaaggcaaggatcttttgctgcaagtcatgtgctgcaaggtacagcagaagttgaacttctgagacaaaaatttgagaaatttcaaaaggaaaactttacctcaaggaatgaattaccattgtaaataaagaggaccatatttttaagccaaaactagggaaattaattagatctcaggaaatgtggcagatactgacactggctgcagtttagaagattgttgttaaaaaaaaacagattttagaattaaaaataaaacccttttgcaattttattaagagcagaccaatacttcaaaaaaactttgttgttctaaatagggggccacatttttttggtttagtattagtgtatttttagtatcaaattttaatctttagaaacatttataaataattcccttctaattataaacaacttgatcatacacaaaatttatttcataacttccccctttatgaacctttttatgacttacttggaccatagttgacatacttgttttttttgcttttttctatacatcctgtttcttaaataactagtcgttttgctttaggacaacaatttaccacataagagtctttctcaaataaattatttttttcatattacttatattttgattaataaacctaaatatatttagtattattataaaattgaagaagccaagaacaaacttatatttatttagcaatttgttggttttttcttatttggatatgaaccggacatttaatgagtacctattatttaatttaccataactttaagattttagattacatgaaaagtttatttataaatgtttattctatttatagtcacctaatctttttaacaattatatctagagtttatatgtataatcatctaattttttttaacaactatatctagagtttactatgaaaattgaggtattagagctagtcattaagttcttttattagccaacttggtagcctgttaatatcaagtgtttacctaagtaagagccttaaagttaaataaatgggtatttggttgataactcacaagctatagctgtttttattgaatcaacaatattaaaataatcttacttatcaaagaattgcacaaaaatcattctgttttaggctgggttcacagctttataaccttaaaggatctaacagaagcaaataaactgtctaatcagttcacccaggcaaaaaatatatgttgacaattttgggacatttctaattttatgttatcaacaattttgaagccaattaatatatccaatatttacttaagtcatgtgaacgaaaaaaatttttgttcattgctgtatattttatatgagtgctcatttatctaaatagaattctttaaggaatttttggccagctatgccagattttgccatgtagacacaacataaaacacaatacatgtacatatgtgtaaacacatctaaacacatatacacacacaccaagatcttacagcatcagcagtaagcaaataactgtggaaatgactttaaataggcgtagttaaaaacagaattgacaagaaaatttggttatttctgtggtttacaataacttaacataataactatgattgatagcatatactcagacatattagaattttagaaaccccatataattttggaacatatattaatatcattcactaaaatatagcctgaagaaggttaaacattagtttttattttgacaatgcttctcatgtaacttaacatgtcaaataatcctgttaacctctcttttggatgcttcaggggccctctgtagcacctcaaagttagaggtcagaaaagacaattttgaagctgaaatttgattttgggaagcttatcaaatatgttattaaggtttaaaacacttaatattatgaaatagaatcccaggtcaacataagtcattcatttagccaaaatgatgactcaaaaatataaaaggcataaacctttactcattgatggagggaagacttagctttccaaacaatctgtctcgtctttcccttctttttttggtagtttattcaaaaggcaaacaaaaatgtttcatttttaaaaatatagcataaaaatcttgttcaagagagaaagccaattttagcattgcattagtgcattattgatgtcaaaccccattcttaataaaaccttatagacaaatatgttcaattttaatgtctgactataagataagattctcataagtcttttttataaccctttaccatttttgttaaagagcagatcagtgctctaaggaaactgttgtggttttattccaatgttcaatttacagaaaaaactgagtaatacccctttaaatttagccaatatgttcatacatagaatctctgttacaattaatttttcacaactgtttcacaacttgttcaaacctttagctttatcctaatttaaaacaatactttaaccctctaaactaggcaaaaatttacatttccatgccttgttataatcttttagtaaaagcacattttgctttcctcatacactttgcatgtacaactttttttagtagtcttaattacatgttacaatgttaattcttagcaatattaatttttggtgaaaaccctgttaagtaagtgattttaattacgtactaggtttggagcctaggacaccagacagaagtacagataaggtctgacccttttcagcatagctaggggagtggttaattccacatgtccttaggtctgacctagctgttaagcaggcaagttgaacaattttcaaaagccaaagaagcagtttatgaccttaaagcatttagtaaacctaatatctgacctacctaatttatttacttattttattttattattattttttttgagatggagtcttgctctgccgcccaggctggagtgcagtgttgcgatcctggctcactgcaacctccacctcccgggctcaagcaattctcctgcctcagcctcctgagtagctgggattacaagcatgtgccaccatgtccggctaatttttgtatttttagtagagatggggctttaccgcgttggccaggctggtcttgaactcctgactccagggatctgcctgccttggcttcccaaagtgctgtgattatgagcatgagccactgcacccagcctgacctacctaatttagaccaaatgtctttattttaccagtaatctttaaaactgtttttatttctcagagattactaaagtcacgtgaactacaaggcattacagttttttctttcaaaatattttatttaagccttatttttctttaagccaattacttagagttcatttatataaacatcacacacacgacacatatataactacacagatagaaaaagatccactagttgtaagatttttcatttgccagtttttaagtttcttaattagattactggcttcagggtggggtccttcaaggagcagggccaggaaaggatgcggtttctaggacctaataaggaggcacaactgaatgacaaaaacagatctccaaaattaagggtcccatttttatattacatcccagatccctaaaaagaggaaaatgctatagaagacagtgcaatgcttttaccatgcatttaattgcatggcaacccaaagccaatcagcccattttgcaatcagcctgtcccccgtgagagtcaattaatttgactcctagtagggggtggggatttttccgtaccttctaggtggccaagagcatgcttctctgattcaagcatggttagtatccccccataactgccattaaccatctctaaaagtatatttcctacctagttattacacacgaaagttctcttataatgcaagtaatttttgatacccccaaaactgaaaaccttcagataacacaatgcaaaatctatttactttcaattcctggggtttcatgaggaaaatcgagattttttcccaaaaccgggtctatggcacttcctctgtttttcctaaggagtcccagactattggaagttatcttaggtcttctcatgtgtgcattaagtgtggcaagaagacaaaatggagaaaaacaattcagttgactgagaagaaaaaacaaacaaacctattttcttcagaaaaataagatccaagaagggaataaaaacccataaaggccatttaaatatacatatagcttggatatatgtatccaagtcagctttaattaaactgacttttaaccacagcactcacaaaaatgttcttttaatttctcattactctagtttagccagggcaaacagccaatatatctggcttttaaactttaccgtaagtaactctacgagtgaaaccaacaaacctcaactaaggttatgacttaaccatgagtgtatgaggtattttcaatttttacaaaattaagaatcttcaaaggtagctcagagaaaggaaaatttaagaagggaagccagaagttgttaatggaggggaagggaatcaacaaacggtaaaggtcacagagatgtccaccagaatgtactcattctgtaagctaggatagaacccaggctgccattataaaatggcaaacccttagctgctgagctaaaacattgggcagtttccactgcttttcccacaaagagtctagagcaatcaattttgagcttgcaatggcttttaactactcaaaataatttttagagctaactatgatatgagccccaaaattccttttccctagatggcagagaccaagagaaagtactgccacactgttacaaggtcaagctcccaaggacataaaacaagatggagacctcattcagttttctgcttgtttcaggaatctgtagcaaagtttgtaaccataggcaaaagcctctcaattttgcaagttgccacccaactagctgcatggaggacccaaattaatgttttccattctggccagagaaaaatacatgtgacaaaacatagacattagccactctgcttagcacccactatcgaacttgtgaggctcaaacttgcccccagttggtccctatcatctttaatacattcaaagtggattaaaggagtttcaacatgtgatctttgggcaagatggacgcccttttaacagaaaagaaagggaaagaagagaaagggagaaaagcattgcctgtggcagagtggggaagatgaggagctcagggaggccagagaaagacccacccattgcagggatgctgaatcaaaagttcaggcggctgattgttggtcgtgaaggatcttttcgagcagtcccatcagctcccaaattttcccctttggggagaaaaagttccccacgttctatggcctggtacacgcctaatcctatcacccactggtgttagcaaagagtgcaaggcagatcactccaaagagaatagtggttaaccccatggtgccaaatccacgtttaacaaagagggactttactgagggggaaggcctccaacccaatcccatcctttaccaggtaaaatgaacccactactcacccaaagtcagcccattggtgctgcggtctatttcctttggatcgggatcgtaactaagctaaaaggctagcagatttaattttttaagtcaatgagtcgcataagctttcgatttgccttttgtaaagtctttaaataaaaatactgaaatctttttagaagcttctgcatatcaatagacatccctagatgagactaacttgggagccctcattttcaaatgcacttcagtgcagttttgttcatttggaacattccactctaagttatctttagtaagatttcaccatttctataagactgctgcttccggggcctaccacttatgcaggtattagccagaaggaactcagttcttcagaaattaaggatccaggccgggcgcggtggctcatgcttgtaatcccagcactttgggaggcgaggtgggtggatcacgaggtcaggagatcgagaccatcctggctaacacggtgaaaccccgtctctactaaaaatacaaaaaaaattagccgggcgtggtggcgggtgcttgtagtcccagctacttgggaggctgaggcaggagaatggcgtgaacccgggaggcggagcttgcagtgagccgagatcacgccactgcacttcagcctgggcgacagagcgagactccgtctcaaattaaagaaaaaaaagaaattaaggattcaatttttacctcagattttggctttgctctcaggttcctttgatcaacctagccaatgatttttctcctaccaaagtgcataagaaaaatgaaacaaggccgggtgcagtggctcacacttgttatcccagctctttgggaggccgaggcgggtggatcacctgaggtcaggagttcaagaccagcctggccaacatggtgaaaccccatctctactaaaaatacaaaaaattagcagggcgtggtggtagacgcctgtaatcccagctcctcaggaggctgaggcaggagaatcacttgaatctgggaggcagagagtgcagtgagctgagattgcgccactgcactccagcctgggcaacaaggtgagactgtctcaaaaaaaaaaaaaaaaaaagaaaaagaaacaaaggggtaaaacacaaaaatccctgtgaattttcaatagcctaattttacacccctgcaatattaccatttactacgtttctttctgacccagtcagatgtaagaggcctctaactgtatccaagccagttaattaccagatcaaatccattccttgaaccagcccagtttctgtcatgacttccaaacccagtttggaacagaaatttgctcaaagaaactcggagagctcaaaacacaaatcagtggagctctgacattggagagaaaacttaccatgacttccaactgctctgagagatcaacgaacacaaataggtcctgcaggtacctggcttcagtcactcagcactcctgggagtcgttagaagctctacttcagatctgctctgacaccatctgataaaagaaaaacttcagctgaattaaatttaaaggagcttaagtgagcaggcaatgaatgattcgcgaactgggcagccttctgagccagagtaggctcagagactccagcacagccacgtgatggaggaagatttatggacagagaaaggaaagtgaggtacagaaaacggaggtgaggtacagaaatagctgattggttacagcttggtgttcaccttatttgaacagggttcaaacagttggctacatttgattggccaaaactcattgattagcacaagtgtagactacagtctgtttacacctccacttgttatagttcatgatgtacagaaaaacctttaggctgaacttaaaatatgtaaggaggcagatttaggctaaattgatttattttttattatatttttaagacggagtctcactctgtcactcaggctggagtgcagtggcgtgatctcggctcatcacaacctccatctcctgggtttaagcgattctcctgcctcagcctcccaagtaggtgggactacaggtgtgtgccaccattcctggctattttttgtatttttagtagagatggggtttcaccatgttggccaagctggtttcaaactcctggcctcaggtaatccacctgccttagcctcccaaagtgctgggattagaggtgtgagccaccgcacccggccggctaaacttgatttaacagtacctttggggagataatttttttgtataatggaatagttactctaattataagctgctattatacctcatttggatctgggaattttctcatgtgatgtatgtacacacacacacacacacacacacgactaatattgcaatattcttttttgtctatgtttgtgtgtccttgtagaactttctatagcccagtctggaagtgtagggaaactgtatctgtttcagagtgaaactgctctaggggatgggaaattttgagtttattatttccatgagaaaatggaatggggcttcttttgggggaagatttaaaattatctgtggaaaaaagtgagttggacttggtaatgtaagatgagaaatttttcattattatattcaatgagatagacacaaatactggtttccttaatatttctgaaattgtatcattgactatgatagatgagactactgttcaaacatattcactcttctacctctccatttcactggaagagtgtagttactggttctattaatgttgggcatggctctgacttgctttggcctcagggtaggtgggggacagttctttgcctctcgactgtgctcagccatgtagcttgctttggtcaatggatgttagcagatgtgactcacggaggaatggaaattaccttgcatagctgggcttgtcctcttgaactgctgccatctccatgcataacacttctttgaactccttcagcctgagccccagatggaatatcagtggagaagtttaaatctcagtgaggagccaagtccagttggactcatagcttgaaacagagctgccccattgagctcgcctaggtcagctagccccagctgacctgcagtcatgtcaattgtatgtcactaagattttgtggctcttttttactcagctttagctaactaatatatcaccatatcagggaattttggtaggacaacatagctaagcacaatttgagatggggaatagaatagggtaaattctctgttcaaagcatatggtaatctggtgcctattttacttattatcccatttgtgcccttttttataacatgtctttggaagcgaaactgtacatccagtgtctctgtaacactgagtctattgtccatgtaacattcagtctactgaactgctttaaaatattagttgaatgacagtagactgaacgaatctctgtagttccagaaggcagggagaaggattgggagagtcgacacaaagtgtgcagccagggctgcgttggtatttttcctctgatgtgctccacagaatggcagctgacccactgtgggttgataatttcactggttcacagaagacagggaatataggactttagggaaataatgtgcctttgtctttgtctttctcttattctctatcaagggggaaaatgctgctctgggctggttggattcaagctcatggattggaccatgggataaagttttagtggcagatggctacttccttgaaatagagtggagaaaaagggtggcagcattggtgagaagggacaggcaggaggcagtagggaagtccagctttactctggagagaagaagaggtgggggtggggagggcagggccagctgtttggggtgggaggcagggaaggtgttggctgcccagttgacatctcttatctctttcctggggccagagtaggttattttacagcccagcctctttatggcctcagcagagaagcaaaggcaaacaaagaacaggtgatccctcagggcccaaggagacgcctcctacagcaggtgtgcccacttcagcagccctgctggccagaatctctacttagaaggcttctcggaaggccaggcccttatcggcttccgactttgaagtcctaggaaccctccctcacacctcccttctatgtggctttgaaaatactttgatattctatccctatcccttaattatttgaaccctcaccagtttgtaatgagcctgaacccatctttgctccattttacatatgacaaaactgaggctggaagcgttgttgccaagcttctttgccctttgtaccatgggatttaattacatatattttatggattctttcctttataaagttgtaatcattcattcttttttaatagagagaaatttagaaaaggaaacaaagcaaaaaatgacctaaaatcctatgggtcagataactcccgttgatattctttccttctttcccccagttctatttccagaggttaccactttcaatttttatttctgtttcattctataaagatgaagaaaatttttgacacctttaaaaatataatttaaatcatcttaaacttatagaaaagttgaaagtgaggataaagaacattaatttttctacgccatttgagagcatgatcccggcaatttgcatgaacaccttgctaccgcctcatctgcaggctccactaaagtttcatcagctgtcccaagatacacaggtttcattctcctgtctctggtctccttcaatctggaatggttctcccttctttccttgacttccatggccttatgtttccagatgacaggccagttattctgtagtgtgtccctcacctgggttgaggctgatgcttcttcagggttggattcacttgcatgcaccttcagcaggaagatcacagaagctgtgctgcgttttccttgcatcctgtcatgtggtgagtaatttcactctaggattagagatggtgttcgctatgatcatttgattacagaggtgactgccagccttctccactgtaaggtgactcttctctttgtaataaacaaatattttgtgatgaggcacactgaaaccatgaatatattccattcctcatcaaactgtcactttactccatcatttagttatattgaaatggactcagatttttattttattcagtaggttattatccatcatcattattatttactttgatgctcacatggtcgaagatttggccatcaagggccccttcaagccaggttctgggcttttctggcctgcacccttcattcttagagtacttcattactttctagctcccaagatctttcaggtttatcttgggctttcccagcccttgccctggaatcagccattttccgaaggagacttggattcttttaatggagaatggcatttagaagtcaatatatgggtgctaggagtgttcattgctattggggtatcactgctcctagactctctcagtggacagagcaaggatatatatgcacacacactattagatcaatatttatctctctatatagaaaaccatgagctcacttcaatactttcaattctaatcaaaaccacagggcttattctgggtttccctccttccatattcatgactgccttctccatgagtgagaaaactggctcccaactttgctcagttggtccccctgcatatacccaatcttccatagcagaactctgcccctccactcattctgtgtggctctgacatccacacttggttgtccccttctgccatgtggactttcatttgacagtacttggactctaacaccctgtgctaggccaccgtgcccctgcctccctgcatggccactctttgtcctattctggctctgacatgccatgccaggctcccccacgccagatgggtgccatctggtacatatcccgtgtgcttagcttagactacccgggctatgatggctactgtcccacccatgcccatgtgctgcatgcatcttatgaaggcatctggtttattctccctgctcatcagttcaatcagcatgtgctaccagtgtagtgcaccagcataccatctgtggatctgtgggatgttcagaagatcaaggtctctgtagaccacactataacagaaagctggaaaacgaacatgatctgggagaagacactgactttgtacttctatccttgccaggtgaaagcaaacttctgctggttcttaccgatatagatggggagaaaacacaagctgagtcaatagctacatattaagtgctgagagtggttaagttgttctatgttgcatttagaaaagcagctaaaattggagttactgcctgattaaatttacgacgacatacagtcattctccaagattcagcaacttcctgcacaggctaaagagctaaagaggtgagccaagtgggcagaaatgtgacaggcctccctgtccctgcatctttcatgtctttaatcatggcatcgatccctgtaattcccctagaaatacagaaatgcaggtttactatttgcgtagggaaagaaaatcccaggctcctgggcctgttcaaccatttctttgacctcatctctccttgcttgattttataccagttgtgctggagtaccttctaatatggtttggctctgtgtccccacccaaatctcatctctaattgtcatctccacatgccgagggaggtacctggtgggaggtaatcggattatgggggcagtttacctcatgctgttctcatgatggtaagtttccacgagatctgatggtttaaaagtgtttgggagtccctagcctctctcctgccgccatgtaagatgtaccttgcttccccctctgccatggttgtaagttttctgaggcctccccagccatgtggaactgcgagtcaattaaagctgttttgtttataaatcacccagtcttaggtagttctttatagcagtgtgaaaatggactaatacacttccttaatgaactctctcagaaaggattcaggaaatgtaagcttgcaagtttagaaatatccttattctacctttacacttgatattatcgctgagataagcgttttaggttcaaaatatatttccaggagtcctaaaaatatagctccatcttttcagagtcttccatcatcctatgttgttgacaagactgagaatggtctctgtctctcctttcctttgtaggcaacctttctcttcctgctcccacccatggaacattttagaatcttcttttttttttttttttttttttttttggtgttttgaaattttgcagtacctgtctaggtgtggagcagttccccgggcttccttttaatctgtagctctggaatactcttgctattgatgattctatgtgtcgactattttgctcacaccccacccagatgcattctctactgtggttctctgctcttccctgtgccaggggaagctgatggctcctttgctggcagggctccagttgggtttggtcaatgggagggactgacaggagactggaagtggaaggagagagaggttggtagaattcttttctacttccccttgcttccatgctgtctggaggcggtggcatgcctccacactacagaagctcccactgggggcccttcctctgcagtcctctggctgtggtaatgtggttttctccttttgttcttttaactgtagggtggtgattgcttctgtcttctgccagtctctgggtgcctcaccatttcttgtttctttcctttaacgcttcccacacctctgtaagttacctttttattaaaatccctttgtttgacaatctgggggtgaattatgtgtcctgtgcagactatgactgatatgctgcctttcattgtcttgatttttccttcctggaaattttagtaattggatgatgggtcattagtgttaatcatccatgtctcttattttagctctgaagttttccatctttctgtgtttttgctctacattatgggatatttcctaagctggttctcccatcccttctaatgatgtgttttcaaatttcagtagtcatgcttagttttcaaggattctttcttgctttcttagtctgtcttatttcacggcaatctgctcttgttatatggattcagtaatttctctaatttaggcattaaaggaagttttggtctcttaaagttattttctattccctaagttatttcagcttcttttggggtcagttattttgtttattcatcttgacctatctcctttgtgctgttgattttctaaatgtgtgaggatctttggttctctgttataagtactggaaaataaactggtttccccggatagctgatgtggcttccctctgctatagccttccatgaaaaaagtaggacagcttccgggagctagctatatgtgagtggaccatgcttggcagctgcccttcagaatgcacaggttgcgggcagggatggccaaggacatttctcagggagctgtgtgtatgggatgggtctctgagaatggagagcttgatgagttcaggccgtggaagcaacatctacacaagcctggatctgagaaactcaaccatactccctgaaaatggagagtttacatgcagaatgagtctgggggaggcagcactagaagggctgaaagaggaagagagtcagactgatttcagagggacccatcctagagggaccactgccatgactccatggggacatttccaaggggagccacaggaggtttcactggagagttgtgtatgtctgtccagtgtctaggaggtgctcaccatggctgagcttgcagggcctcttaggactgtccaggtgagatgtgtgggtcgtgatgagggtttggagaggtttccagctagaattggtcgggacagcccattagctctggggcagaggctcagggaggtgggcaagcatgcaggacacaggaatgcttatagccacagctctgcagggtgtttcttgcccataactgtgtggagagccattctcatctcaactcatttcttgccacaacatctcccgaagcaaactttgttattagctccgctttgcagatgagaatctggggcaatgcgagacggcttctgtgcccggcttgtgaccagtcaccacactgactctcaatgtggtgtaagcaactgtgaatgggcctgattccaaatcccagcaaatttacagtaaggagggtgcctggggtctatccatcccctgactagctgatcttcagcttcctcataggaccagggggaatactgagcatgcagtggactgaggttcagagaggtaatgtggagcgctgcacacacctgagggagttgtgcgcctgtctgacttccgggtgattcatgaggaacattcctgatggggtgggaagggaacctgtcactaagctatttaggagaatcagtctccagcaggtcacaccagccagccacttttatggcagaaggaaaatcctacctagccccttccccagagatggcagaatgcagcctggctgactggcagagcctctcaggctgtgctccggaccctggactccagcaagggggaagaacagcagctcccagttctttcttacagactgctttcttgaggagcttcaagtgctctggctatgattggtgcagggctctgctgcctccagagggtgctgtctcctttccctagcagaggcaaagggtctggcaggcaactctgggagtattggtttaacctgaaatgtctgctaggaagagctacctacccctctcctgggcattatggtcctgaaggaagagcttggactttggattgaaagtccagccctaccatctacaagttggctggctgagacaagacactctacttctttgaggctcagttttctcgcctgtgagatgggatgatcacaccacaccagttaggcatgaggatggactaagggcaggttcacatgcttctgcctggcatgggagctgtttgctgcttttaccaccatttcagctcttctgctgttctctgacccacaagagctagggttcaggctgcgtgccttgcgcagtagttctcaaatgtgtctatgtggaagcttgcctccaagggcttaccagcaaatccagaccccacacagctgccctgcaagaaggaggtgacagtggctgcgttcttgcctgcacagaggacgggtgtccatagagctcccagctggagttgagcagtttctggtcaagcaatgttctctgattttacatgtctggaagctaccattacaatcaggtcttcttaaatgtcctccctccctccgtcttcctttcttcctttctttctttgtcagatgctgtgtgtggacttgtgctgggatctggaggcggagacaagagctgtgacctagacataggggagtggggaacaaaggtgctcaggcagacaaccaactaggctgctacatctgcctctgcagcagagcatgggagggtggtaggaatttgtcatggcagcagggacatcggagctggggtgcaacagaggagcagccgctttccaggtagtcaagacaggaagcagcatggtccagaaagaagagatgacaggtgccagtctacagcgatggtgagcagaggcctgggggcttggcaggtgggttcgcatcctggatctggctgtttcttagctgagtgactttgggcaagttgctcaaccactgagtgtcactttgcttcatcagcacgatgggaataaaaatgcccacctctcagagctgttgtgatgattaactaaggtagtgtctgcagagtctatgcactacaaacggcagctgccattctagagggaccactgccatgacttcatggggacatttccatggggagccacaggaggttcactggacaggtgtgtatgtccagtgtttaggaggtgctcttgaagcagatctgttactctcaggaggttctctaagcacatatgtgactttgccatgtggggatggggggcagggaattataagctagtgtattcaaaacaggagcagcccttgtaagcaaagctgttccattatagccaagtcatgtgcatctcagctccaaaggagaaagtgaccattctcattgaattctcatcgccacaaccttgggactgcctgagataagacactccacttccagggcccaccctgagttttcactcacaccctggatgcccatctccttccctcaccctggctgacattctcagccacactgccctcccctggtctccaggggctgaatgctcccagcctcagggcttttgccgtggctgtgccatccatctggcctatcgaacccatttgctcacagcatctcaccccctgtaataatttatttccctctttccttgtaccctgtctgtcttctcccccagggctgagagctccagaaggaaccaaggacagggagcctgtcttgtccagctctggtgcccagcaggagagccaggctcataggaggtctgcaagtaatgtttctggacgaacttatgaaaggcaggtctttttatacccatttcatggatgaggaaactgaggcagagagagagagagacaggcagacgcacacacccctagacagagagaaacactcctggagaaagagaaagggagggagagagggagggggagggagggagagagagagagagagagagagagaaagaaagaaagaaagaaagaaagaaagaaagaaagaaagaaagaaagaaagaaagagagagagaaagacagcgcagctccagcctgcctgtatccagggttgaggtgggcgtgagagacacacgcaggcagggctgcagttccgggcaggccttgggggctcaagatgcggctccccagggcgagtgctggggtcccggggcaggcgggcggctggagcgctctcgtgggcgggcgcaaggggcaggctgggcgggcgcaggcgggagcgtagcagccgctccactccgcacgcaggcagcatcggggcagcaggagcaggtgaagcaggcgcggctctgccccgcgcctggtgccccctgggcacaggagtgcggccgggggcggggccgagtgggccccggtacgaaccctccgggaagccgggcgcgctgcctgcccttggcccggggcgcagagcgtcacactggatctggggagcatcctacccccactgtggacctcagtctcctcacctgagacatgggcggccccatccgcaccctgtaagccgcaagccaaggaggtaaggggtgcatctgaggtgtctgggcgctatgggcattaggatatagtagcttttgctgagatttcaggagacaaagcaaagggccttccctattctaaccccactgggagattagcattttgtgtatgattcattaattttcctctgattgactgggaaggcaggctgcagggggtccctgttggggcttgcagctggttctagtttttgtatctggagagctgcctggggacaaaatgcagagacaccattttattgaccttgcgtaataatctaccctccccctcatacactcgccacccccttgggtgtgcctgagggacttgaggtcccctggtcctcactggtcagtgtaccccaagcccagcagccccaggcagatgcccaacaccaccttttcagtgctcctcctcctcctgtcttggccctctctgccaatccattttctatatccaagtgatcttactggaatggacctgaccttgctggtctggcccaccactccagcttcatcatctgccaccctggaacctcttattctgcttacttttcccagcaggctctgctccttcctgcctctgtgcctttgcacatgctgttccttgcacttcgagttccctcctctccctgtccctttggctggttgactcctcttcagcctttgagccctgtaccattgccacctcttctctcacctccctgctccctgctccttctctgatctctcaactcacaggcctctctttcatattggtgttggcaatggcaatgagttccatctgcattcgtgctggtcagcccctctgctctgggagggccatgactgtataagtcatctttgcagcccttgtttctagcccagggcttgacacacacttattgagtgggtgaatgaagcagtgagcattttctggagccctcccagcccagtccttccactctgatcctgctttaggtggttggtttgggatgaatggtgtttctccacaccactggccaagccttgctgatggtcacccagagccttgggttctggcccatttgctgcttctgagtgcagtgcctctgccacaggttcatgcagctgggactgctctttatcttatattgggccctgtgtttggctctggaatagtttattttgccatgttcagccccaaatggccctttttgccagaagaccatagtgctggagaaatcttcctgccttcgagatctggttcctaaataaccagactgtaaactatcaggtgaattcacagcttgatcttttaaatgaccaaatgagactcttttttttttttttttttgagacagagtctcgctctgttgcccaggctggagtgcagtggtgcactctctgctgactgcaacctccgcctcccaggttcaagtgattctcctgcttcagcctcccatgtagctgggactacaggcatgcaccaccacacttggctaatttttgtattttcagcggagacggggtttcaccatgttgaccaggcaggtgttgaagtcctgacctcagaaactcatctttataagtagatcagatgcacagcgagtgacattcatgacagccgacaaatagagtttactgagctctggttgattttggccttgtgctctgcaaaaactgccttaacatagcaattgatcatgtaaaaaatacatatggccatgatatgagacttaaagaatatctcgaatagggttttctgctatagtgttttacaagatggggtccaagggccatgtgcatcagaatcacatagtctacttgttaaatacagattcctggcccccatcctggattcacttaactacatctcctggtggaagggccctgggatctgcactttcaacatgcttctagaatgattctgatgtttactgaaggttgagaactgcaaccctgtgggattaataatgactagagaatctgagaggtgagtcacaatgatgtatgtagtggtatggtgcttcccatgcaaaacatccatcattggcactaacacgggggaactctggagtctaaattccaactcagtcttggcagggggtccgttgtgctgaggaggtcctcggagaagggacagcctgtaccagggcatagagatgtggaagagtctggtgtgcttgtgagctgcacactgcatcaagtgacttgaacatagtcatggagtaggttctgtggagggcactgggcacctgtgactttggccaggtatgtctgtgcacatggtgggtagtaggaagaagctggtgtgctgatgagccaggctttgcatactgggcagtcttcagttttgccaggtatcacctaaaaaacaaggctaccagggcagggaggggctgagaccaggagggtgcactgattgtggatccccgaggctttagctctatcttgaagggaatggggtgccgtggaaggacacaagcaatcctgtgcagagtggcatttattgctgtctccattcagataaaatgtgacaaggggcattctacccatgttccctgaacaattccgtcactaaagtctgcatacagcactccaacttttttatcatcagaacagcctcatcctgaggccggagggaattagtagaacaagttctggcattagatgacctgagtttgtaactgggccctgttactaattagctgtgtgactatgggcaagttgctttccatctcagggtcttagattcctcatctatgaaacggattgataatatctacctctaggaataaactagctaatagacgaaagtgctgagcacagtacccagcatgcaacaagtgcttctaacaaggtagcaatcattggatgccaatgtctcaccatgagccttaggtaatagcccctccagataccagccttgggttggaagcagctgagagcctttctacccggccctgctcctctctggattctaccctgggcatgatccctgagtattgtttgtctgtttgccttgtaggcgtcatccctcaagtgtatcacttagttcaagagtcctggaatcttttcacatccactatgaacacctctcacctcctggccttgctgctcccaaaatctccacaaggtgaaaacagaagcaaacccctgggcaccccatacaacttctctgaacattgccaggattccgtggacgtgatggtcttcatcgtcacttcctacagcattgagactgtcgtgggggtcctgggtaacctctgcctgatgtgtgtgactgtgaggcagaaggagaaagccaacgtgaccaacctgcttatcgccaacctggccttctctgacttcctcatgtgcctcctctgccagccgctgaccgccgtctacaccatcatggactactggatctttggagagaccctctgcaagatgtcggccttcatccagtgcatgtcggtgacggtctccatcctctcgctcgtcctcgtggccctggagaggcatcagctcatcatcaacccaacaggctggaagcccagcatctcacaggcctacctggggattgtgctcatctgggtcattgcctgtgtcctctccctgcccttcctggccaacagcatcctggagaatgtcttccacaagaaccactccaaggctctggagttcctggcggataaggtggtctgtaccgagtcctggccactggctcaccaccgcaccatctacaccaccttcctgctcctcttccagtactgcctcccactgggcttcatcctggtctgttatgcacgcatctaccggcgcctgcagaggcaggggcgcgtgtttcacaagggcacctacagcttgcgagctgggcacatgaagcaggtcaatgtggtgctggtggtgatggtggtggcctttgctgtgctctggctgcctctgcatgtgttcaacagcctggaagactggcaccatgaggccatccccatctgccacgggaacctcatcttcttagtgtgccacttgcttgccatggcctccacctgcgtcaacccattcatctatggctttctcaacaccaacttcaagaaggagatcaaggccctggtgctgacttgccagcagagcgcccccctggaggagtcggagcatctgcccctgtccacagtacatacggaagtctccaaagggtccctgaggctaagtggcaggtccaatcccatttaaccaggtctaggtcttctccctgccatgtcccttgccaggctcttccacttagctaagtgggcacactgcaagctggggtggcaccccagcattcctggctttctggggtccagataggctggcaagagctgtttttgcatccatttgcatcgtgaagactggcattttgatacttcagctgtttgttcctgggagaattctgagcacagattccagaggtcacagtaagccttgcagcttgagctgaaagatgccagagccggagatgtctgctggcagcaggcagggttcattctggtgacacagcaacagatgcctggcctgggaacccagggatttcacctccaccagtgagaccacggggccactgtggggtgagggaaggagcgcttggagtcagagctctagaccttggtcaactcttcacctctgtgagagatggtgtgtggaggtgcttcagaagtaaagaattctaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcaagactccgtctcaaaaaaaaaaaaaaaaaaaaaaaaaaaaaaaaaaaaaaagaattctgtggatgcaaagcagtgggattactgttagatcattagcgcatccagctgaagacaatagatgcagtagtcttggcttacagccctctgcagcaggaattccaggactcacttcctactccatcccttttctctatcactgtgtcttccaccttacatggaaatcagcctgcaagttcctctcctcgatgagatggcaagcgccttgcaggtgaaatccataccatcatggggcttgtgtcttacatgccatggacaggccctggcacaaggagagagctccagggaagttttccatggtgggttgatggtaaaggtgccactcactgctgaatgtttggtgctggacaggagtccagcatgggaagggggccagggctcaggctcctgcagccatagtctcctgcctgcccttccttgcctcccaggacctcatttgatacagtagctggactgagactctgtggctctccccactgttgacccactacagaggcctccagaactcaaggctatggctgcagcctccttcactctgtgctctgaccactgagctgacttgccccagataatgtgccacgtatctttcaaagcttcctcagggtattgggcatcccagtggccttaagtaggatcaggggcagggagtcctgggagtctaacttcatggggcactggctgaaaaaagcaggtgtccccttcctccagccatccagggaaaaaggagaaagggctccaatgagtgtgaatatcttaccttgggggttatggcctagtcctctggatgctgaaccaggcccaaggcttcatctatgtgtggaccagacagcctgtccttacagggaaagaaatgtcaagactgctcctgggctgcattggatgggatgtctccgcatggttctgttggctcagactgaccctccagcagagtggacagtggctggcctactatagcctcccagggcagggtattcatgtgctagagccctggaagagcctcatcataagccagcataggttctgcaaagggggtctggcatagggctctcacccctgaccaagaaccggtggaactgacgcccaagacaagtgctctttgagccagcagctcccttcctggagctgtttgtcttatcgcttcttttggtcacatctcccattcagttcctttgttcatttttgtgttggattttgggcagatttcttgagccattctcttggacacagcttgtgcttgtcctgtggtgccatctgctgctggctgctccaggtgaccacctgccagcgaagcccaggctccgggacccatctattttgtgaaaagcccacatgcacaaagcaacccccaaatgccaaaggagccaagagaccaaagaaggaagcagacaaatccagtttgttggtattgagtgatttattgagggaacttttaagcaggcgggtggtctcgggtggccacaagacaggcagatctctgcactgttactctcggacccaaggcttatataccaagggaaaaggatatacatgctccagcaagacagtgaaaggtagtgtgccagagcaggcaagaacgccatgtgcatcatagcccagaatttgcatgataacatcaagcttgctttgatctaaaagcaggagtacatattcttacactcgggacagtaaataaagtaggagtcaggaggcattcatgggactggggctaatcagaagtcaacatgggaaaattagcatccaagatggagtcacttttgtcttcccatcaccccagaaagatgtcattgttcaagcttcccaaagaattgggggcctcaggccccccctggatcccacgcaagtgcctggagttgcttctcattattagtctcgatggtgccaagatgctggggacaaagatgatttcaggtgcagacatgcttgaggatggagggccaggctaggcctctggggaaagtgtttggtgctaagaattggggtagtgggtagaagcctcgttgagtgtgttctgtgccccagcatcacctggagcttgtagatattcagagtccttgttgccagcccagctcgattgaatccaaatccatgttttatcaggatcccaggttaattgtgtgcacattaaagtttgagaagctctgctctaagaaacaggttgccctggagcctagagacactgggtaagcacctgtagacacccatcctagttctgggaacgtctctaaaattgttattgctgaaaaggtgcattcagttttggttgtctgtctcatctctggctgcatgtggtcatattttttgtgaggctttttcattcttttgataaatatttgccatgtgcatagtttgcatagatatgttcttagtgaacatggctttttgtattctgctctatttcacttaaaactgtatcatcaacagtttttcatcttgctggatatcttttttttttttttttttttttgagaaggagtttcactcatgctgcccaggctggagtgcaatggcacgatcttggctcactacagcttctgcctcccggattcaagcaattctcctgcctcagtctcctgtgtaactgggattacaggtgcctgccaccacacccagctattttttttttttttttttgtatttttagtagagatggggtttcactatattggccaggctggtctcgaactcctgacctcaggtgatccgctctgctctgacttccaaagtgctgggattacaggcatgagccaccgtgcccggcctagatatcatttttgatggccgcttacaagtgtacaaactgccccagtgaaagccagtacccctcagtatctctagctcctgggggtggtggggggggtgggagggcatctctagccagcaagtggaccctctgccacccattgtgggaggaacccaccttacagaggaggatcatggctggaattggagactcataccacaaagactgactgggaacccttggaagatgcaaaactttatcacgtcctggctgtgagtgctaaaaccttgcctaatgctagcctttcttttttaaagtattgatgtggcctttttttttccattataaaagtaatcatattcattctgaaagatatacaatatatacaaaaataaaattgaaaaaaggaaattatcaggagttccaccactcagacataatcactgtttacattttggggagtcattttaaaagttttcatatgcatagtcatatacatatgtctgttttttaaaaaaatggttgagagcatagtgtgtccacatgggaacttataaatcatatttaaggattgttttatatcttttttgtttaacctgatataaatttttattcacttgtttattcattaaacaaatatgtcagacactatgttagctgcggggatacagtggttgtaatcagacattgtccctgttctatgcaacttagagtccattgatagatatatcctatgtccttaatatcatctgttgtggcattctgagctgtctctagacctgttgcatagagttttatgatgaacgtctatgcaaagaaccttttctatatttggaattatttccttaggagagatttccagaagtggaattaacaaagggcatggacagttttcaaggctcttgacgtgtgctgcaaagttgatttccaaaaaaggtctggaacaatttcagggcactccctgaagagtgcccatttcaccgtaccctggccactgttggtgatttaccattaaccaaaagactttgacctgtatcgcccagactggagggtgtcccagctcctgcctccaggtccagcaaacactgtgggcactgaccattcaaggctagcctgaccctgtccctctgtgaaacctttgggggttccacaaagcctttagggttgcaggaccacataacttatccaaacagggatacttgagcatgaaaggggccaccatgaataatcaccctgggacaacaggcaaaactaccctgggaaatgggaacatgagatcatcctactatagataaatctgatccctttaacatagcttaaattcaaccctctccaccatctggccccaacttaccttttcagtctctttgcatcctgacatatcacacgatccagtcacagtcggcctgcaattaccaaccatgccttgggtgtcactgtctctgtacatctgctcccgccattccctcctcctgcctccagccaccccaccccccgccagtctgcaatgcgccccctcgcccatctgtgtaggtccaaatcccacccttgcttcaaaacacaaattaaatggtaccattcaatactgctttcattcaacaaacatgtactgactgcttacgatgtgtcaggcacatagagtacaagaccgaaaacatcccacctcctgtggaactttgatttgtgtgtgcaactgtgacaactggtcctaaagatgaacacaaaatgatgtgccagagagtctgccctgttatggttttgaatagacacacccaccaccccacaaggttatgagctctttgagggtaaaatccaagaggctcatcctccacccttgcaaaacctctgacacacccttggatagagcaggcacttaagcatttgccaagtgaagaattaatattaaagaagcttacctattcactccgcaagagttttctaataaccagttctgggttctccatgaatctgagatcaaaggggagcctaaatttccacataccttagagaaacacccccaggtcctaccactgtgactctctgtccaccctgatactggaagaaactgaagtcaccggattcactgattgctgcttcttgtgaggttaagtgactcatccaaggtcacacagctagatagtgactgagccactggaggggtcaggaggtgatacaggaaagaatcagaatgcatgagtggataagtcaccaaaggagtcactggagtggaggggcctggaggggaaggtgaccctgagtgctggaatggccagagaagaacaaacaagctaacagccccaaagacctccattgtccccagatcccattcactgtcatctcctgaagaacatcactctcacaccatcagtgttctctgctcctttttgcacaaaactcctccagagacttgtctagcctctttctctctctttttttttttttttttttgttcttttagagacagggtcttgctctgtcacccaggctggaatgcagtggcacgaacatagctcactgcaactcgaactcctgggctcaagtgatcatctcacctcagcctcttgaatagctagcaccacaggtgcataccaccatgtccagctaattaaaaaattaaatcttttttttttctttttttgatagagactgggtctccctatgttgtccaggctggttttccttttttcttccttttttgtagagatgaggtctctctctgttgcccaggctggtcttgaactcctggcctcaagtgatccttctgtctcggcctcccaaagtgctaggattggcatgggatactgtgcctggccccctgtctaatcctgaagcttccacttcctctcctcttaggtgctcaccagtccattcatatagctcttgccatgttgccaaatcctgtggccagttctcagtcttgtctgatatggtcgtcagctgtattgggtagttggtcactcccttctccttgagactcctgcatgtggctttttcagggcataatggtcatggttctccctgcctcattgggctcttcttccccatctcttttcttggactcttgttgccctgattttgggacactggagcatccccaaggagccctggaggtcctctcattcccctggtgagctcacccagttttctggtgctaaatgccacaaatactctaatgttccccagtgtatctccagtctgaacttctccctgacctccagatttgggtgtccaggcatgctttgtgtttcctagacaccagtcagcatctcaagcttggcacattcaaaagcaaactccagatttgtccctgctacctccttcctcagtgtcctccttttcagaaaagggcaagtcctgcttttcatttgcttgggccacagtctttgggatcacctcctattcacacccctcatccaatctatcggtgagttctgtaagctgtgccttcaaaatgttctcagaatgaccacttctcactgcctccaggctctgccttcaggttcaagccaccgtcctccctacggagatcatggcagaggcctcctttctggcctcattcagccagagtgatccactgacactagtcaggtgcctctacaactttgttcaaccctccagtggctttccatcatactcagggcaaatttcacagtcacagtctgcacctgtgtctgcagatcatccgcccctctctggcctcacttcccactacccttcccctcacccactcctcttcagcagtgcttgcttctctgctatcttttgaacaggctaagacctctcccgcctcaggcctttctacttcctactcttgctgcttggaatgccaccccttgatatcaactttctcccttgctcccttcaccttaagtgaacctttattagaagattaatttcctggctgggcatggtggtttgtgcctgtaatcccagcactttgggaggccaaagcaggcagatcacttgagcccaggaatttgagaccagtctagacaacacagtgaaaccccatctctctctacaaaaattacaaaaatcagctgggcatggtggcacaagcctgtattctgagctacttgggaggctgaggtgggaggattgactaagcacagaaggtcaaggctgcagtgagccatgatcacaccgttgcacaccagcctgggcaacagagtgaaagcctgtctcaaaaaacagaagactaattttttaaccatcctgtaaaaatataaccatcctccctctctcttcccttttctgcccagtttctgccacaggacttagcacattggctggttctttgttgagggtctccactccctcattagaacatgaaccccatggaagtaggcactgtagatgttttatttactgtccagctctcagcaagaacaggctgttcacgagaggtgcagaagaaatatccatagtacaagtgaatttccaactgttatagttcatcagtggagagctgcacttcagcctcttatttgtggagagcgggcatctggttttgtagctgtttggtcccaagtttgacagccgttgtctgctgactgaaagggagctgaagcagctccctttgcatcctggtttcctggtttgtaataataaacactggctgccatgtatttagtgccccaaccactgtgccagatgctttatatacattgccttccctcaatcctgagatcagatagatgaagaaactgaagcttatagaggtgaaataattttttccacattttcaataagagccaaagatgaaacccaatcagttgtcttccaaagcctatgacttagactgttgtagcaggaaggacagttggccagatgacctccaagtggccttgaagctcatagctagaaagtatgagctttatgggcaatggagaagcactgaaagcttttaagcagggggatggcatggtcaggttacatggagggagagtagtgtggctggattggcctgcattccccagaaagcagaagctggggcagaggtctatgagcttttcctttattagggagaaagatcccagggaacaagatgaagaatatggggaaggagacagggaaggagggagagtcaatctgaagatgcgctactgagctggcagctgattactcggtatctcttaaaaccatcttaggacagtttgtctggacgaaaaaagaggtaagaactcatccatcggtttccatattcccttggcaaaggttcgtacatggagcattacctccccacactctggggacacacaggaacactgaacatacctggacataaacagagcaggtcctgcagagatgagaaggatgtttggggtgtgaggtgaggcgccatcaggtcgcacctgtgtgaagccagtgagctctctcagagctggtgcctcagtgggtgctggaccaagaggccagtgaggacaagaggatcataagcagagcagaaacagcatccaattcagggtcagaggaggtggtgtgggctgaactgtgtccccccaaactcatatattgaattcctaaccaacggtacctcatcatgtggccttctttggaagcagtgtcattgcaggtataattagttaagatgaggtcatactggaatatagtgggtccctaatccaatcccttggcaaaggttcatacattgagcattgtccgtataagactggtgtccttataagaaggggaaatttggacacagaaacacacacagggaggatgtgttgtgaccatgaaggcagagttcagggtagtccttctacaagccaaggcatgctgaagatggaagtaatccactagaagctgagggacaggcacccaacaggctcctgcacagccttccgaaggaaccaaccctgctgacaccttgaccttgaacttgcagcctccagaactgtgagaccataagtttctgtcgttttagccgctctgcctgtaacgctttgttgtggcaaccccaggaaactaacagaggaggtgagattgggggcagggaggcccatctgtggggggcatcatgtcagtcaggcactcagtaactgggggaaaatcccaaactcaagtgggtgatggcaaaatggggaaattatcggctcatggaatggggctctccaaaggaagttctttgacttcaggcttgattcaagggtttgaacgaggatggtagggctctctagtccttgcccccttgtctccacatgttttgaactgcacgtttgtgtgcctccagaattcctatgttgaaaccctaacccacaatgggatggtatgtggagatggagcctttgagaagtgattagatttagttgaagttatggggattcttcatgacgggattaggcccttaccagaagagaccaaagagcatgctctctctctctctctctctctttctctgtctttctgtctctctctctctctctctctctgccatgtgaagatacatcagggagatgtccatctgcaacccaggaagagagccctcacgaggaaacaagcaggccagtaccccagtctgtaggacttcccagcctccagaacagtgagaaataaatttctgtggtttataagccacccagcttaaggcattttgtcacagcagccagaacagaccaagagaggtgcctgtgtcttgatctctagagagagcattggccaaggccaacccagccatgagagagagacagagagaggcagggctgggctgtggctggctggggtgtggactgatccagagctggcagtgggccagaggaagttcagctccccagggctggatctggtgagaggacatggaggtcagcaaacaagttagggtcctgaggcaccgggtgggggtggggttcagcaaggaggtcttggtggacaggatgtggcagtggcagaggagctagttctccagagctgagaccagagatgataccaggtaagtggcccttcacctgtgctctgtggcctcacttctgtagagaatcgaggccagcttcagggtcaagcttctcggctggaagctgggagttgttgctgtggttcactgagtggcagggatacagtgatgactgagaaaatgctgaagagacctggaagtcccccatagaagaaatctgattcttacagcgctgcggagaggcagtctgggaaggcctttcttcccagagtatctcttcaaggttctgatacacctcacaagccctgcaaatacagacagaccggaatggggctcccaggtccagaggagatattgggaaagggtccgaggagcagagcaagatgtctgcttagccggcagtagccagcactcccggcctgggcagccaaacaggcatctgcaaggggacttgacaatgatcggtggagcaggagggtgcttgagagtgtggctgcttaatcatggccttgaggtttgttgttgtttaaatgtcaccacttatttgaaactaattcctgtcagactgcgaaaagtttatcagtgtaattgggtgccggcaaaaagctctcttaaaatacacatcctttcattcataaagctatcaatggggcatttgattagcatctttttgactgccaaggaaaccatactgaaagcagggcatgcattcagaacaaagaactccagctcgtgggtgaaaactctgcgatagccatatctcccccaccagatagtgtgctttgtgatggctggcagcctgtgccccttggaaatgtcattttcagccccttctgggcttgtgactaaggtgtgggtggtggatctacaaaggatttcccaaaaagaaggcctcctttacataccttttgttctgtggactgacccacttgtcccacccacatacctgcagcaggcgggagagttgtgccttaactgggcagctgtgagcaccagtttttttccccaaattcctgggtgctatctgagcatgctgctatttggcagtggggcctcagtcacatcctgatggagaaaatgtgaaggtttgtcatcagcttatttaacaattcagaggctggagtctattccactttttgtccagtatgtagctttaaaacagttacatataacatggaacagtatgacatgaaaagagagaggtttatagagggagatgggaatcgtgacagcccctgcttacggagtttgcccctccagtcctgaattcttctgcatccccacatcctgcttgtctggaaaacggctgcagcttactacttcgattcttggccttccagaaactggactcctggcccatcttttcatctctttggagaaacaaacaacaaacaataatctcgtcataattaaaattcactgtgatataaagctactctaaaaatagtacaattaaaattaaaatttatttcatttcttgagctgacatttcagacagccaggggcctcccactaaacttgaaggtgatgagtctctgctcagtctcacctcccgggcttctgttccagcatgagtctgagctccattcaactcttcccgggccttttcagctctaggtgtaaaggttcagtgtgaactcgtagaaagaagacaggcttttcagtcaacagatctgaattcttacacgcactgtctcatagtccttggtctcagtttccatgtttgtacagtgaggatcatgggttccaaggatttgggttccaaggtggggttggacaatgaaaccatagctgtccagtgtggtggccatgggccacatgtgacttctgagcacgtgaaatagaactggcacaaattgagatgtgccaagtgtaaattacacattgaatttcaaagacagcccctacaaagaatgtgaagtgtctcattaataattttgtatattgattatatgttgaaatagcaatattttagatatattgggttaaagtatgaaaatcaacatcaatcttttcgttttactctcactattttttagagcagctttatagtcacagtgaaatggagtagaaagaacccaaatgaccactccatctgtcctaagccagtctgagggctttctgtccagccctaacgctgtaccatgatcctcactgtacaaatatggaaactgagaccaaggactatgagacagtccttataagaattcagatctgttgactgaaaagcctgtcttctttctacgagttcacactgaacctttacacctagagctgaaaaggcccaggaagagttgaatggagctcagactcacactggaacagaagtccaggaggtgagactgagcagagactcattaccttcgagtttagtgggaggccactgggctgtctgaaatgtcagctcaagaaatgaaataaattttaattttaattgtactatttttagagtagctttatatcacagtgaattttaattatgacgagattattgtttgttgtttgtttctccaaagagatgaaaagatgggccaggagtccagtttctggaaggccaagaaggacttcccgtatccttcctgggccccaaacatgcacagcctccccgttagctacactgtccactagagtggtgtgtttgttacagttgatgccagactccatggttcggggtttgctcttggtgttgtacattctatggatttggacaaatgcatcatgacacgtaaccaccattatagtatcacacagaatagtttcatggccctaaaaatcctccgtgtcttacctatttatcacctcctttcctgttaaaccctggcaaccaccgatctttttaccatccccgtagttttgccttttccggaaagccatgtagttggaataatactgtaagttgtctttcatattggcttttttcacttaataataagcatttaaagttcctccatttcttttcatggcttgacagctcatttctttttagagctgagtgatattccattgtctggatgtgccaaaatttatttatccactcacctactcgaggacatcttggttgcttccaagttttggcaatgatgaataaagctactgctgtaaacatccatgtgcaggtttttatgtgaacataagctttcaactcctttgggtaaatatcaaggagtacttttgctggattgtatggcaatggtgtgtttagttttgtaagccactgccaaacttcagccgattcctggtttccctattctcggcaggctggcctcacaaagttcgtctcctgcagagctccaaggaagctggttttggctgaatctgaagatgatcaacactggtaggatgctgctgtgtcatagactggaaccccagctcctgatcatgctggagtggggctgctgctccctgcaaccccacctgcctcccccttgagctggaagagaagggctgacggccagagttctgccataccccactacgatcagatcaagctctgatcccaccaggccaggggctgtgcttccttgatcatataagcccaaggtccggggtcgctctcctggagtctgacatcagcccggctaggtcccagtgcgctgctctggaagggtcagaacgcttgttcctgagcttatctctgtggattttccctgatgaactctgatctagcaggcagtgtatgggctgctaagtacttttcccttgtttgctcaaggagtttgcggccccaagatcatttccaaagccttttgcttcagcttgctaaagggaagctgctgtcactctcttcagcttgctaaagggaggcggagttctgaggaaggcaggcaccttaagggatgttgaaagttgcctctgtttgctgtgcctaccacctacttctagtcctcctctcgccgcccagatcatcccctacaatgcattacccatgcctgccccccaccacccagaagctatgggggctctggtccaagccccacacttgtccgaaagaggtgcctgggccccacagaagccttgtcagatgatggcagctctcttctgatagttcaatggatctgccacctacacagagaggtctggaagtcgctaactctctttgagtctcagattccatagtagtcaaatgaagggtttgaaccagaatattttcaagaatttgtgctcttctaagagtccatggtttttttaaaagttaatttaagttttaaaatttattttttattttatttaaacatttttatttattttttaaaatcttttattttaggtttcagggtacatgtgcaggtttgttacataggtaaacttgtgtcatggggatttgttgcacagattatttaatcactcaggtactgagcctagtacccaacagttatttttctgatcctctccctcatcctactctccatactcaagtaggccccagtgtctgtcattcccctctttctgcccatgggctctcatcatttagctcccacttataagtgagaacatgtggtattttgttttctgttcctgtgctaatttgctaaggataatggcctccagctctagcctacactatggaatactatgcagccataaaaaagaacgagatcatgttcctgtaaaggacatgatctcattcttttttatggctgcatagtattccatagtgtatatgtaccacatcttctttatccaatctaccattgatgggcatttaggttgattccatgtctttgctattgtgaatagtgatgcaatgaacatgtgcatgcatgtgtctttatggtagaacgatttatattcctttgcgtatatacccagtagtgggatttctgggttgaatggtagttccgtttttaggtctttgggggaattacctcactgttttccacaatgattgaattaatttacactcccatcaacagtgtataagcattcctttttctctacaaccttaccagcatctgttattttttgagtctatgatttatctttgtgggaaatagagtaattttaaggccctccaacctctccatggaatgaagtagagatctgccagcaaagccagcatcaggaccgagtagaatatccagtacatggcaggtgctgcgtgatttttgttaaaatcataatctcattttaagaggactgtcctacacaggccaagcttgattccatggctcttccagttaatttcctcatctaagttagtattagccatgtccacatctgagctgtgctattaaaagccagaccagcagcctcattgctcccatcgacaggcatatggtactagataaaaagccataaatgtccaaactgttgagaaaaaatgtgagatgagttgagggggacacaggttgccagcctgccactctgggccccgtgctggcctgggtgcagccctgtgtcctgtgttgctgacctgtctcccagtgtcaggcttgggcctccctaggaaaattttccatggggctctgggcctcctcctccctcctgccttgcctgaactggccccacactcaggactggggagtgtcaaagtgtctgagcctgggggaaggaacaaatgcaaagcacgtgaggattcctcctctggggagagtttatcccataagtaatgacatcacggttccccagccttccaggatggcatcctcaaggtcatcttcatcctctcttcctctacaggctctgccactgcagctacaaactgcagcgaaggcccccattaggaaaaatactccccacgactttgccagcccctgttctggaccttcttcccctcagagccaagccccacaagagtgttctacactcctggccaccacactctcactttctctttgcttctcagctgacaggcattttcacttctgtgactgctgaagctgctctgcataaaagcccatctctactaaagataaaaaattagctgaatgtgatggtggacaactgtaatcccagctacttgagaggctgaggcaggagaatcacttgaacccaggaggcggaggttgcagtgagccgagatcgcaccattgcactccagcctgggcactaagagcaaaactctgtctcaaaaaaaaaaaaaaaaaagcacaagtggcatggtcttgccatgcgatttgggtccttgcaatacttgatctttgcagcttcattcttgacatcacctccctgaaatctcctcttcccttagctcccatggcctgactccagctaggtcctctgtccctcatatgccaggctttcctggttctgctgtagcttttgtgtcctgcccccaacaccctccataagcaattgcaactgtgccccgttcccagactcacaccttctccagtctccgtctacctgcaggctggacgcctccacggcgtgttccacacatacctcaagtgcaagtccaaagcaaaatatggtccttctcagattccagctggattttccatcacagttattcctattgtgaaccactgaattgcctagttaggggcatctgattcagacttgttcctttagcttggactatgtcaagaacctccctcaatgacatctctgccaccaggccttttgtccagcgatcctttctctggacaacgtctcacatctgaccttgactctcccactcagcggttcctgccctctgcaggatggggtccccgtgctttcacatggcccctggccattcacagcttccccctggctggccttcctctcctgcttgttccagcaccccctcactcccaccccatgcttgaatccacagactccttatttttgggtcctcacatatgccacactgtgcccagctcaatgccttccgaatctcatgctttccaattccaagtttaccttctctgaaaacttttcctggctcccttgtttcgtgtctgcatccctggattttgcactttgccttgttcctgttgggcacttagggaatcttagagctggaaggatgcaatagagtctccatcttttcacctggctgtaaccccggcaaacaaagggtgtaggttgttatctcctgggcagctggcacagtgcctggcccagaataatgccccctgagagcacagtaaattggtttccaccgtgaagaacagatattggagcttgaaggtgagctagcctccaacaggggaccagggaggtgctaggccagcgagcccaccttccccacgatgcagccaatcaagactccagagggctccagcaacagcatgaaaaaaatagctctccatacaaagcatggaaactagactttagggcctaggggaatggggcttgtctgcctctatgtaagaaagcaggacaggccgggcatggtggctcacacctgtaatcccagcactttgggaggccgaggagggtggatcatgaggtcaggagttcaagacctgcctggccaacatggtgaaacaccgtctctactacaaatacaaaaaattagccaggcgtggtggtgggcgtctgtaatcccagctactcgggaagctgaggcagagaaatgcttgaatttggagggaggaggttgcagtgagccgagatcatgccactgcactccagcttaggcgacagagcgagattccatctcaaaaaaaaaaaaaaagaaaagaaagcaggacagtatattgcaaattaagctcaataaaaagagagaaagagagggagagagagagaaagagggagggaggaagggagggatagtgagaaggaaaggggcagtcaggcagaccatggtcccctgccaattctctgggcaccggtggaagcaagttctgcgtcttgggcacagtactttatcacctgattgtacttcctccacctctccccaggcagaactattgacccagggatctataacatttgtatatatcaacacagaaaccaattaacaaatgcttatattcctgtgcaaatatgcaaacttccttctgcagacaggggtaagcagacacctggcagtatttttagaaatatttaagaaacacagttcaggtaagaagcaggctgctgtaccctcctccgggaggaccagtacctagaaccatctgtttttctttgtcttccctgctctgctctgagcgtggggatggtccttatccttagcttcatctttattaaagctggcattttcggctgggcatggtggctcacgtctgtaatcccagcactttgggaggccaaggtagatggatcacttgaggtcaggagtttgagatcagcctggccaacatggtgaaaccccgtctctgctaaaaatacaaaaattagccaggcgtggtggcatgtgcctcgagtcccagcactcgggaggctgaggcaccaggattgcttgaaccctctgcagtcagccaagattgcgtcacggcactccagcctgggggacagagactctgtctcaaaaaaaggaaaaaaaaacagctggaattttcttcagtgcttacgctgtgccagatacatgcatttactcacttcacaatgagagggaagccactatgtttatcagtgaagcagggtcatttgggaagcattatccaacaccacctactatgggcccagcccatggcaactggaagcagcactactcagaaggaaaggcatgtggagaagctcagagctgacaggggagtctatacttgattgtaagatttctgtacaaaatgcctttctgtgtgctgtatcatgtagtgaaagataagaaacaatagaatgtccagcaatcagagaaggcttgacatgacaggctactttttaacagcactgagaaaagcttgctatctattaaatattttaaaatcaggtgctaagccgcagagtaagcacctcattatttggaaatgcacttatacattcacagaagcaacacccctggaaggaaataccccagtgatcatgggattgtagtaacatttttgtttgtactttttatataccttaaatttaaaattccttatgaataggtgaaaagcctgtccaggaagctttgtagggtcccctgagttcttggtgttctgtcagtggaggctggtttgagtcattcctgtaggagagctacccaaaacaaaacgaaggggaagcaagagatgcaagcttctaagcctctgacaccttttgcaaaattgctttcctgcaaggctgtgctgcttcacctgctcccccaccagctggtgtgagaggcacagggtttggagcagacagctgtgttctgaagggatggcattctgtctggtgacacttagtggcagtccacttttctcccacaggttgctggctgatctagttgccaaggctcctgcgtaggtgttatctccaaacatgcaggcatagttaagagatgagaaatacacgtgtttggacaaaagactggagcacagttcaatcagcctcagcaacattatctctaaaagcaaatgagtcctgctgttgctggggacctacccctctgccttggctggaagtgtttgagtctgtctgaacggtctgttatctccagggcaacataaagtttgcaggaggcctgttcactccaggtgttatcgctgtcgctgagatggtgctaagcctacaggcggcagaaggccaattgctaaggcagagggagcctttagtggggagccaggcagcctggggaccctgggccacagcttccttccctatgacatgcactctcatgcccttcccactcaaacatccagtcattctgcacgtcctggtagagggagatgccaggcgaaccctcggggtaaccccagcacctggaaaaactcctcagtgggtttgctcagtgtcatttaaggatcccaaccttgaaggttttggacttgggatcacacattgtttcattcagagtgttaggataggggtctgtctagttcaggcatctcaagttagagatgagaaaccagactcagaagtctgacggtccttggaggctggccgagagaaagacctgaggctccccgtctccctgcctgggcacctcataccaccttgcttttccctgccccatgtcaagagcaagctggagccgaatttggggctcccagttgggctccaagtgtgatttcctccacacttgatgaccaggaggccatttgtaggaggctgggatgagcaaagtgggtcaaagtgccccctgcctccaaatgctcgcgtggaggttgggcagtcagacaccatgggggagaaaccccaggactttagcagaacaaaagaagggcaccctcccttcctgggccctgccagactcttggcagaaggccagggctactcatggggcggggagtgggggaaggagggaggagcagggatggtctgttccagccctcctgtgttcatcctgagccgagtcactgaggcctgcagcacagctatgacacaacttttggggtgtcctggtaggagggctttgggctgcaggtggggcattggaagcagatttctctctatagtaaggcagtagatccccaggccttgccctctgttcctgaaaatgtgagttgtaccttgaaccacaaaatggctgtggggtgcagcttggtgtgttggaaggagggctttggatgtgggctgcaactgcatcatccttgctcagttctcatgtggcaggtgtgctcctgcctggtctggggcagtctggcaggctgctctgtagccccaagcctggatctgccaaaactggcaaggagtggaggcctccccgtggagcagtgcctgaacctgcagcccctggggcagacactcctggctcctgggcacctcactcaccatggctccccactttcttagttggctcgggccgctattgcagaatgccatacaccacgtggcacgtggacaacataagtttatttcttacagttctggaggctgggaagtccaggatcaagtagctgaaacagatttggtttctggtgagggcctcttactctttcatagatggcgccttcttgctgtgtcctcctatggcagaaggggtgagggatctctccagggtcttttataagggacctaatcacccctgcacaacccagcctcctaatagcatcaccttgaggtttaggatttcagcacatgcactttgggtaaacaccgtcaatctagagcatcctccccccccatcatgctggcttccagactctgctcccaagtgaatgtccacacccaaggggggccctgagtcttccttaagtctctttgtctaggacagactgtgctgaaagggcccatctaatctcctgatatggtttggctgtgtctccatccaaatgtcatcttgaatgatagctcccataattcccacgtgtcgtgggaggggcctggtgggaagtaattgtatcatgggggcaggtctttcccatactgttctcgtgatgctgaataagtctcatgagatctgatgattttataaagagaagttcccctgcacatgctctcttttgcctgccaccatgtaggatgtgactttgctcctcattcaccttccaccatgattgagaggcctctccagccatgtggaactgtgagacgattaaacctttttcttttacccagtcttggatatgtctttattagcagtgtgagaatgagctaatacatctcccaacagcctgggccccacccacccccactcctcaaacctcctcagtctgtccttgtacaggttccttctcctccagccccatctcgcttcatgtgacttctttcttccttaaactctctgcactctctcctgctcccaggattttgtatctgcagtttcctctgcctggaatgtactccacctggtctacaactcccagctagcctggagtggagagcttctatgtcactccctctgggatgctcctgctgacccccaagactggctcaggccctgagttcgaccctcttgtggttcagagaattcctgggcatagccatgccctcacttgtgcttccactgccacatggggttgctggactgttgtccacttcctcaggggcatctgcttcctcagaacagggcctgggcattttgtcacctaggattccagtgccagcacagagagtgggctcagctgcagacactcagcaatgttgactgaatcaggaggcagcaggtgactcgatgttatgggctcacgggaaaacccctctcctcttcagagggccttaccctgaggtggcctcaccccagttgtcttcactgggtatgggtctctttgcccacccgctgctgcctcactaaccttcctggcctcagacaaatctaaactcaagtcaaaaccagggtgaagatgggcctacgtcagctccagagagggacagcctgaattcccctccctctggtcccatttccttgggaggatcagcctcttcctggatgatgacaccagggctcttcaccccctagggaggggtccagcccatgtctgtggctctggtctgggccctgaggggacacacagtaagtggcaaacacagacggaccaggccgagagcaagacaacatcctcaatggttaagatgtataggccagagggaaattgatcaggaaatgaacttagaagtatccagggactgatggggaaggagctgtatttggaggacctgtgatgcaagttacagaatcaaagatgtggcccctggttttgctgtgtcctcctggaatgggtagcaggacaggagccaccatgcagagggtggtcacacactcgggcttgctttaacctgggtctttccttaccaatgcatttctggctacactggggaaaacgaggtggctaacacattttttttaggtgttagaagacctgtgtgcactttctctctttctccctgcactccagccacactggcctttgagtttgtagaatgcctacactctgctctgcctcagggcctttgcatgtactgtgctcactttatggaaagctttgttctcaatctcatccaatctctttaattatttgaatgctatccatccttcaacattcagttcaaatatcatagccagtaaaatctgctgtaataaactctcttagtttcctccaatttttcttcctaatatttatctcagtttgtagtcatgtattcttgcgatggttgggctaatatctgcctcctcactggtgtttaacctctagtaaacactagaggtttaatctctgaggtcacatctctgagggcagagatatgagtgacaggtccagtcttattcccaacatcaaggccagagcctgtcaggcagcaaatgcttagtaagcatttgttgagttgactttgaattgtcagagctagagggtcggtttagcattgacacatgggggacatcatgggagaagccacgttttgttaggacctggccctggggagatttcttaagccaaaggctttgggtctgccacccttccatccaaggagaagtctgaagacagggtcagcattttgtttgtcctccacagttgctaactttttttttattttttgagacagagtctccctttttcacctaggctggagtgcagtggcatgacttcagctcactgcaacctccgcctcccgggttcaggcaattctcctgcctcagccttccgagtagctgagattacaggcatgtgccaccaagcccagctaatttttgtatttttagtagagacagggtttcaccatattggccaggttggtcttgaactcctgaccttgtgatccaccctcctcggcttcccaaagtgctgggataacgggcgtgagccaccgagcctggcccacagttgctaacttttaacacacaggacatttcatgtaaaaattgtgacttgcagcttcttttgaagaatctgaagtcaagcagccctggcctgcatttgtgcatggctacctttgtgggatcttggtcacagctgaccctttgggtgggcatgctactcttcagttagttgggccctcttcactagttttttcactagtttttagcacctgcttgcccctgttagcaggtatggacttttacctgaacactcagattagaaagagatggaaaaaccacatggccttgcagaataagggagatctcatctccatgcaatgaggaatcagtggcaggcctctttgcagaacctccctggaagggaattgctatggttgcatgtgtcccacaaagtttatgtgttggaaacttaatccccaatgcagcagttttgagaggagggagtaatgtacagaaaaatatccagaaatctgtacagttgatatggcttggctctatgtccctacccaaatctcctgttgaattgtggtctttagtgttggaggagaggcctggggggagatgattggatcataggggcagatttcccccttgctgttcttgtgatagtgagtgagttctcatgagattatcactccccctcctgctccaccatgtgaaggatgtgtttgctttctcttccccttcttccatgattttaagttttctgaggcttccccaaccatgcttcctgtacagcctgtggaactgtgagtcaactaaacctctttaactcataaattacccagtctcaggtcattctttatagcagtgtgagaacagattaatacaacagggttccccatggatctgttataaaaattaggttgtggatgtctatcataaaactccaggaggctgggcaaagggtgattggaaagcagtgagcaggcactttcagagctcatgtgggacatggggggactcctgcattcctaccagccagagtggagcgtccttgtagaaaatctggtgcgttcagttgacatcccagaaaagtcatgtcttggcaggaggagtaaagaagccctaaataaagtctaatctaacccctttccttcagtcaaagcttcaaaacaaacctcaaaagggtcagggtaatttctaagtaactcagctggctgccagaaaaatatctaccaatctttagaggaggacaacaaaatctagcattaagtaaggtataattaacaatgttcggtgtcatataagaaatacagacatgtaaaaatgcacagaagtgcaactcctaccaagagaaaaaccagtcaatagaaacacactcaggaatgatggatgttggaaatagcacacaaaggattgaaaacaccaattacagatatacacacgaatttaaaggaaacatgaaagtaatcatcaaagaaggagaaaaattaaaaaggaaatacaagggccaaaaataaaaatcttaaataaaaaaatttctttatgaaatgaacagattagacgtgaagaagaaaagatcagtgaacttgaaagttgcaatagaaactttcaaaactaaaattcagtcaaaagagactaaaaagaaaatttaaatgaatctttagtaacctgtgggaaaatattcatgcaagtatatggatcacatacttgtaattggaagctgagaaggaaaggaaagagggaagagaaaaaatatttgaataatggtaaaaaatgctccaaatttgatgaaacatacaaaaccacccatccatgatgctcaatagatcaaaagcaagataagcacaaagaaaactatgcaaggtaaaacataatccaattgctaaatgccagtggctaagaaatgtgggtgggcttcatcaaatctattgaagatctgaatagaacagacagactgactctcctgcaagtaagagagaatttcatcctgcctgactgctttgagctgggaggtggttttttttttttcctgccatttttgaactgaagtatcagctttttatgagtcttgagcctgccagcctttgaactggaagtacaccattggctctgctgtttccagcttactaactgcagattttgggacttgtcagcctcaataatcataggagccaattccttacacacacacacacacacacacacacacgttatgcatatgtacaaaattatatatagttatatattatatttaagtataatcatatctatctattccaaaattgggtctctaatctgattacattttaagttgctaataactttatttccaactgtaaagagagcactaatagtccatggcatgatctaacaataaagatatcaccactggatactcctaatcaaccccttataagagacaaggagctgggtaactgtgtatactttcaattattttcctcacactaacaaatataataagactcaccaggtgtttctaatgtgaagtgatactaagtggacaaaggatgaaaaacacttaatggtaagtatgtgggtaaatacaaaggcttttctcatttttaaatttccttaaaagataattgattgtttaaacaaaaataataacaacgtactgtgtggcttataacctattaaagcaaaatatgtaatgatagcatgatggacagaatggaggaaatggaagtatatggttgtaaggtcttacattgtacataaagtgttataatagtatatttgtaatgagctaatgatacatattgtataccctcatgcaaccactaaacatgaagccagagttatagctaatgaactcacagtggagataaaatagaaccataaacatttttaattcctctaaaagaaatcaagaaaagagaaataaaggatgaagaacagatgaaataaacagagaacaaatgacaaatggtagatttatacccaactatactgataattatataaaatgaaactggtctaaaaattccaataaaaagacaaatatttttagactgtataataaggcaagactcaactctatgttgtctgaagacctcaataatttaaaggcacaggtaggtcaaaagtaagaggatggaaaaaaatatactatgtagcaccaattataacaaagttggaggggctagttaaatatcagaaaaagtaaacttcagaacaagaaatatgcagaacaagaaataaacgagaacatttcataatgataaatttatcagaaagagaaaaattgtaaacatatattcacctaataatagaacttcaaaatatgacaaagaaatggacagaaatgaagggggaagtagagaaatctacacttatatttacaaattgtcatacttgtttctcagtaacttatagaacaagtagaaaaaatgaataaaggggaaggacacttgaacaatactactaaccaacttgatttaattgatgcctatagaaccttctacctaaatacagatttttaggtgtagtgttttatatcctaggaatgcaaagtcagtttaatcaacagcgcaataaatcaatcaatgcaattcagcatattcgtagaatccacattgtttccaactgaacacaaaactttcattataatggaccatatctggggcagaaaacaagtttatacatttaagaggaccaaaataatatagaacatgttatctaaattcagtggaactaaaatagaagttaatagcagaaggatatctagaaaatccccaagtatttggaaactgagcaacatacttttaaataatacatggatcaaagagaaaatcacaaaagatattttaaaataatttttcctaaataagaattagaacacagactatcaaaatttttgtaatgattagagacaaatttataactttaaatgatttttattagaaaatataaaaagtccaaggtcaatgatttaagctttacttttagaagttggaaaaagaggagccaattaaacctaatgtaagtagaagaaaggaaatcaagttaatagcagaaaacaatgtaatagaaaacggaataataaagaaagtcaataagataaaaagttctttgaaaagatcaataaaattgataaactcctaataaaaagtcataaaacaaactaccaacatcactaataaaagagggaataaaaattacagactatgtagagattaaagaaataatatggggatattatagaagctttacggcaacaaatttgacaacccagaggaaatgggaaaatttttcaaaagaaaaattactaaagcccagtgaagaaaaaatagataacctgaatagctttataaccattaaagaaattaactttgtaattaaaaactttcacacaaggaaaattccaggctccagtgacttctctagtgaattcaatcaaatatttaaggaagtagtagtatcacttttatacaaacttgcagaaagtaaaggaggaggaaagactttctaacttaatttatgggatcagcataatcctgatatcaaactcagagaaaagatactacaagaaaaaaatcttataggccaatgtccacaaggaatatacatgcagctgggcaccatgctcacgcctgtaatcccagcactttgagaggctgaggtgggtggatcacttgaggccaggagttcaagaccagcctgggcaacatggtgaaaccccatctctactaaaaatacaaaaaattagctgggtgtggtggtgtacgcatgtaatccccgctattcaggaagctgaggcaggagaatcacttgaacctgggaagtggaggttgcagtgagctgagatcgtaccactgtactccaggctgggagacagagcaagactctgtctccaaaaaaaaaaaaaaaaaaggaatatacatgcaaacatccttaaaatatttcagtatgttgaatctaggaatatatgtagagggtaatacactatgaccaagagtgcttatcctagaaatgcaaagttaatcagtgcaattgaccaatcaatgaatgcaattctagcagtttaaagcagaaaacccaggtgatgatctagatagatgttataaaagcatttgacaatatgcaatactcattcacgatgtactttttttaaaaaaaataaaatcctcttaaaacactggagtagaagggaaactcatcaacctgaaaaaatgctgtcatgaaaaacctacaggtattatcaaatttgatagtgaaagtcataacgttttcctcctcaggttgggagtgaggcaggaatgtccacttttgccatgatcattcaacactgtaccaaaagtcctaggtggtgcaataatgtaagaggaaataccgacataagattcgaaaggaggaggtaaaactgaatccattcatagaagaaataataatgtacttgaaaatcctaaggaatttacaaaaagttactaaaataagcgaatttagcaaggtcataagatacaatggtcaataaacaaaagatcagttgttttcctaaattgtggcaatttggaagattaaattatataaataatactgtctatagtaccatttgaaaatacttacaagatgagcaaaatctctatgtaaaaaactatgaaacattgtggagacaaagtgaattgccaatattgttaagaagtcagctctcctgatttttggttgaaattgacaaagcgattccaaaatctacatggaagtacaaataatctagaataatcaaagcaatttttacaaagaatgaatgttgaggacttatctactttatttcaacattacaggaaagccagtaatgaagacatgtggtataggtttcagtttagacaattcatcagtggaacagaatcagatgtcctgtttctggacatacataatatgttgattcctaacaaagttaccaaagtaatttgatggggaaaaagatagtctttgaataaatggtgctaaaacaagtgaagatctatacatgaaaaaagtgaacttcaacccttacctataccataacttgaaatgtatcacagacaaaaataaaagctaaatttgtaaagcttctagagaaaaacataagagaaaatcttcacaacttgggcaggcaaagatttctcagggcacataaaatttttgaggaaaaaaattgataaatgggccttattgaaattaaaagtttttggtctacaaaagacaccatgaagaaaatgaaagggcaagttgcagaccaggagaaaatatacacaggtatttggcaaagtaatggtatgcaaaaattaaaaagaaccctggaagattagtaagaagaagacaaaacaactttatcaaaatgggcagaaaattttgagcaaacacttcccgaaacaaccaataaacacataaaaagatgcactgcagcattacacatcagggaaatgtgacgacccctcacaccatgaggatgcctgaacttaaagatcgacaattctgaatttttgtaagaatcaggagcaactggaactcttgtacaatgttagtggaaattcaggattaatgctgtcacttcgaaaaacagtttggaagtttcttatgaatttaaatatatacttaccatacaaaccagaaatttccacatcaagttaaaaagctgcacagcaaaggaaatgacaaagtgaagagacagcctacagaatgggagaaaatatttgcaaactacccatctgatcaataaccagaatctatgcaaagctcaaacaactaaataggaagaaatctaataatataattaaaaatgggtaaaatatctgaatagacgcttctcaaaagaggtcatacaaatgaaacataggcatatgaaaaggtgctcaacatcattgactgtcagagatatgcaaatcaaaactacaatgggatctcatgtcaacccggttaaagtggcttttatccaagaaaggcaataacaaatgttggtgaggatgtggagaaaagtgaacccttatacactgttggtgggaatgtaaattaatacagccactaggatgaacaatatggaggttccccaaacaactgaaaatagaactaccctatgatccagcaatcctactggtaggtaaatacccaaaagaaaggaaattagtatatcaaagagatagctgcacttccatgtttattgcaacactattcacaatagccaagatttgaaatcactctaattgttcaccaatagacaaatggataaagaaactgtggtacatatatacgatggagtacgattcagccataaaaaagaataagatcctgtcatttacaacaacatggatggaattagaggacataatgttaaatgaaataaaaaaggcacagaaacacaaattttgcatgttcttactcatttgtgggagctaaaaattaaaaatattgaactcatggagatagagagtggaatgatggtcaccagagctgggaaaaggttgtgggtgtggggggtgggaaatggagatggttaatgggtacaaaagtagagttaaatacaatgaataagatgcagtatttgatagcacaacaggttggccagtcaacgataatttttagtatatttaaaaataagtaaacgtgtataattggaatttttgtatcacaaagaaatgataaatgcttgaggtgatggataccttgtttaccctgatgtgattattacgcattgcatgcctgtatcaaaacacctcatgtactccataaatatatacacctactatgtgcccataaaaataaaaaaaaaaacagaaattcctctcctaggtatttatttattcaagaggaataaaaacacctgtgttcacaaggacttataaacaaatatttataacaattttagtagcctcaaactggggaaaaaccccagacagtagaatggataagcaaattgtgatattgctgcagaatggaacactacccaacattaaagcaggagagattacagatacacatgacaaggagaatggagctcagaaacattatgatgagtgaaaggagcccacacaagagactacagtcatggtggtatagtttggctgtgtccccacccaaatctcatcttgaattcccgtgtgttgtgggagggacccagtggagggtaatggaatcatgggggcagatctttactgtgctgttctcatgatagtgaataaacctcatgagatgtgatggtattataagggggagttcccttgcacaagctctctctttgcctgctgctaaccatgtaagacgcgacttgctcctccttgcctcccgccgtgattgtgaggcctccccagccacctggaactgtaagtccattaaatctttttttttttttgtaaattgcccagtcttgggtatgtctctatcagcagcttgaaaatggattaatacacaacgatgctcaatgacagtgatgcgttctcagaaacacatcattaggggattttgtcattgtgtgaacatcatagagtgtacttacacaaacctaaatggtacagcccattacatacctgggctctatggcatagcctgttgctcctaggctaccaatctgtgcagcatgtgactgtactgaatactgcaggcaactgtaacacggtaatatttgtatatccaaacatagctaaacataggaagggtagagtgaaaatacagcatagaagacaaaaagtagtgcacctctgtggggcatctaccatgaatgaagcttgcaggtctggaaattgctctggatgagctagtgagtgagtggtgagtgaatgtgaagtcccaggacatcattgtacactattacagattttataaacactataaacttaggctacactaaatgtattttaaatttttttcttccttcaataataaatgaaccttagcttctttatgttatcaactttatttttttaactttttgacttttttatattaatacttagcttaagacacatgttgtataactgtacaaaaatattttctttctttatatccttatcctataagcttttttctttttttacattttaaattagaaaaaaattaaaatgaagacacacacattagcccacacctacccagggtcaggattatcaatatcactgcgttccacccccacatcttgtcctaccagatggtcttctggggccgtcatgcacatggagctgtcatctcctgtgatgagagtgccttgttctggaatccctcctgaagaacctgcctgaggatgtgttacattaactttttctttttaataagtagaaggagtgcattgtaaaataatcatgaaagtatagtatagtaaatacataaactgctaacagtcgtttgttatcattgtcaagtactatgcactgtacataattctatgtgctagattttatacaactggcagtgcaggtttgtttacaccagcatcaccacaaacacctaaataatacattgcactaggttgttgccaggcgataagattctttcagctccattataatttaatgggatcaccgtctgtagttgactgaagtgtcacacagcatgtgactgtatgcatattcacctcctagaacccagactcatacgaagaagtagggaataccctactcgcaaccatgttttatttcctagtttcttccattggccattttctttttcaggctggagacttccctcccatccccactggcgttcccagtctctctgcctcctaagtcttcctctgttgctctctggggaccagcttgtgcagcagttttgtatcactgtagggtagggcttcaatgagccctgtcctgtgtccttccctggctcactgcgtcttgccttcccttcctcgcacagcccagggcctgacaccacctcctgcagttggtcattcaggagcagggcactcagggaaggagacggctctgcttcgagtatagcctgggcaccatccacaaacgccttggtgtttgaactcacctgtgcatcccagatacaggtatagtctctccaaaacaaagggtgtaggaaatatttttacttctccatctttccaaagtatccttcccttagtatctcagcaaccttccccggagaggctctttgggctgtggatgtagtacccagtatcctgggctgcagattcattgattttccatgctttgattgggtataatcatgctcagagctgagcaaggttggcagtgagtgggtcactgacatcagcttattcatgatctctctgtgctccgattctgacatgaacttccttttctgtctcagaggagagagatttcagggctgtgagcctgaggatggaccaacacgcacgtcagttgtgtctctgaggactaaagatggccaggacccaggaccccagctagcctccagatgctgctggctgctggggacccgtgacctaaggcacacccctcaacacattttctttcattcctgtcaatctcctgtactggtgactgggctgggacctcctgctggcctccagggccccacctgagcctctggtcccggcctcagtcaggcccaggcctaggggaccggcttcttgtttcctttcccgagagctctctgggagtccttacaatagattccaacccaggcacttttgacagtgaaagaagatttgtattattttcttagggctgccgtaacaaattgccacaaacttcacggtttaaaagaacagaaatttattatctcacggttctggaagtcagaagtccgaaatcacagtgtcacagggctgtgctccctacttaggctccaggcaaggttcttctttgctttcctgcttccagtagctccaagcttggctcgtggctctgatctctgcctccagcctcccatagccttctcctctgtgtgtgtctctccttttctgtctcttacaaggactgagtactcaaacttatatctaacaaagtactggtatcaaaaatataaaaattactcctgcaattcaataataagaagacaaacaacttaattaaaaatggcaaagtcaggatgaacttacctgaagatccttaatttaattacatctacaaagctgttttatccaaataaggttatagtcacaggatccaggagtttggacccagaccaaccttttgtgggggccacaattcaacccactccaggattttaataataactattccataacaaaagacagaacaccatgactgtccctccattcacctgcatggcctctgaaacctaaggacaccttagaagtggcatctctagctcggcgtggtggttcatgcctgtaatcccaacactttgggaagccgaggccggcagagcacttgaaatcaggagtttgagacaagcctgggcaacatggcaaaaccccgtctccactaaaaatacaaaaattagccagatgaggtggtgcacgcctgtaatcccagctatgtgggaggctgaggcaggaaaatcatttaaacctgggaggtggaggttgcagtcagccgagatcgagccactgcactccagcctggaagatacagtgaggttctgtctcaaaaaaaaaaagtgtcatctccaccactggctccctgggccacagacaggcagggaggaaaaggactcagatccctcgtgtgccttccaccgacggcttcgcctcctcctctaacaggtctgtggtctgatgttgagtccatgtggcccccagtctatgccggaggtactccccggctaaccctagaagccagttgtattagtcctttttcatgctgctatgaagaaacacccaagactgggtaatttctaaagaaaagaggtttaatagactcacagttcttcacagggcagcaggagagagaatgagtgttagcaggagaaatgctgggcacttataaagccatcagatctcacgagactcactcactatcatgagaacagcatgggggaaaccgcccccattatccaattaccttcatctatctagtcctaactttaacacgtaaggattatggggatcgtaattcaagatgaggttttgggtggggacacagccaaatcatatcaacgatgttatcctgtcagaactcaagagaagggtgagggctgggggagggccgggggatgatcccatctgaagtggccagtggaagcagttggccttctggagagggaggcaggaaaggctaggaggtaggtggccttggaggcccagagggtagggggagaacgtgggggtggagtgacagctggacatcccgaggtagggactggaaaaggaggcctagggagttccagatgtacccacctttctctttgtaacttaatgctggttgcatgacctgtaggtaacgttgcaggggacttggggtacagtatgagctctgtggttccctgctttgagaaaaggaatcctctttacaaactttctatgtgattgtggtgggggtaataataaagagagccccccactgcccaccacaagggcagtcagaggacccacattggccagagtgtgtcacacattggacgtgcttattaggttgggatcagcacgtggacagcagggccaactagggtccattgttaggaaactgagtgctgggagagcagttgtctctccttcggcatgtgctctaaggagtctgagcttggacctgctgagcaccatagctgtctcctggggagactgtgtctgaagctggagcccaacagagccctgcagaggccagagacggggagggaaagttcaggaccttgcttggactcctggatccaacctcacttcaaagtcatggtcacggatttcccagttagagagctcaccttgagaggtggggtctctgtcccatcccctggaatctaggtgagctctatgacttctctgacccatagagtgaggcacatggtgctgtgcccgcttctaagctcagggctaagaggctgtcagcttccacttcctgcctttctgatccagatgccatgctgtgagaaggcccaagccacatggaggagctgtgcctaggcctgcagaccacagccctcactcggttcccagctgccagctatgtgaggaagccacttgggatgtccagccctgtcgggcctttggatgactcagacgccatctgactaacccagggagagaccccacacaacacctgcctggcttagccaagccaactccttcaactgtgaaagatggtgacaaattattgttttaagccactaggttttgaggttattatgcattatttgaaaataattaaaattatttcaaaaactgtttattgtgactgatatggatgcctaaggtccttgcataaatgtgtcctcacttgatttagatgccaaaataggaatctgcaccttgaatctcatcatgagctccatgaagctttgggtagcctcaagaattctagagtgcaggggcttaaattcaaataactctggcagaacactgatggcctccctcctctggctgtatcatgcacagcctgcttcagctaaggggacagaaggagggagccagcatttctctgagaaccaattataaacaccttgggggaactctcatgatcagtaagatgctttctgagcatcgctttatgcatatgctaagaagctggggcaagagtagctttttttttaatagtacattttatgtaaatttttactgaagtgaacagacatatacaaaaatacacaaattataattatatggttcgattaatctttgccaagggaaccatgtcaccagcactcagattcaataattgaacattgtaagcacccaagaaactgacttgcaccctgtgttgatcatgcccccccaacagtgatagtcacctcattctccagaggccttaggcattgcctcaggatcatggtggaagcttctctgggtggggctgcttggggaccagccatcctgcagtgggcccatgataagcacctgtggcgccacacccctggctagcaggcctgctgggaacacctgtaggaagaccttggcaggatcattggcccttgagtcagctgcttgctcaacttcatgatcagagataaaggtgaatgcaagtactgtggccatgccatgcttaggactcgagaatggtgcagcctctctgtaggccagggaaggaccactaatatggctcccagccaagggcctcagggattctgaatggcacagtctctgcagaacttgcactgtgtggcttcaggtcttccaggacagctaaaatgtgtgggccttgagggtgcctttgggtgctcatagcctcattagggagatgaagaggtgagcagatgtcacatatgccaagacagtggaagcattaagaaaggggaaaggatggggaggatatcaccccaaaggtatgggaaaggacctggtatgtctggaaagtgaagaaggccagtgtggctggaacaaaaggcacctggccagagagctgggagatgagggcagacaaggaggaaggggctttccaggcaaggctgaagcctggatttacccagaaggcaatgaagagccaccagacactttaggggggccatggtgttgtaaaatgaagcatttgggctttgtcccaggttcctggaagggagcttggcattttcagggtggcaggagtgtctttgctattcatcgtgggtccctggggccacaccggagtttatgctgaccaggtgcttcaaggtgggactccatagcttcaggatgcaggctggccaaccatggcaagaccagccatgtgaataaagggtcaggactttgagccacatgatatcagcctgacctctggggagagagtgggtattggaattgagtacaaaggtgtaagcaatgatttcatcaatcatgcctaggtaacaaaccccaataaaaactctggacattgtagctcagtgcagccaccctggttggtaatcgtataaccatgttctgggaggcttcacatttgggaatctccccaaacctctccctgtgcatcttttcatttagcttgtcctgatttgtaccaatcaataaaactggaattgtaagtgcagaggttggtgagtcattctaatgaattatttattcaacttgaagccctgagtgggagcctctatcttggtagccagtgattggaagtgtgggtgcactgggaatgcagctggcatcctgcagggccctaagtctgtggcatctgtgctaacatcaggtggttactgtcaagactttcttcactcagtcaggtctgtgcttcaggtgcactgctctgtggagtggggagggggcctggagtgcatttctgctcatggggctcatgatttgaactcaggcctaatatgttaatgagcagacacctggccaagccctgggggcctcaaaaaaccaagacaggggaagcatcaagaatgtgatgagagagtacgcggccatgggagtgtcacctttgccttctcttctccctgtggctggaaaggctggcctgtctggctgcccaaggatagacggggagaggtttaattgaatcacctactgtgttgggtaaagtaaactgtcgtcattgcaaatataatcaggactgtattttaacagtagaaaatgtgattataatgacatatttatcagctcctttcacctgggtggatctgaggacatttcagaaaacaagtgattggaattgcttggcctacctcacacacttacacacacacactctcacacactcacagagacacacacttataagcacacacagtcctgtgcatgcacacaagtgtatacacacccacgcacatttccacatgcatgtgtgtgcacactcacatacacaaacacacagagacacacccttacagggcatctggtgctctggcctgctctgacacgcagcccctcctgggagtgggcagtaagcattggggggacatgtaggtagtccctggggaagctggaaggctgaccacctggcgagcagcagggcacactcactggagcccctgcctggatgagctggctttgctcagctccagctgtggttccctctgtagactgtgggatcagaaagccctcatcacatgatgtaactctcacaaggctgcaatctacttccctgtccaggtcccagaggctccaggctctttgtggagtcacctgcttgggcagccacggttctgtggagctgcttgtcagagagtgcgcaggctctggagtcagtcagacctgggtttgactgctgactccatctcttacctgctgtgtggccatgagcaaatgcctgttctcactgggactcagtttcctcatctacaaagtgaaacgtgttcatacttcccttatggtcagtgaggatggaatgggataacattctgcaccccgcctggccccacaggcatatgaggtattcgataagtgaatgattgtgccagacaagaaagctgcctgccctcctcctcctcggccctgtgcagggactggggtggatgagaaagcccgtgtttcctgaacacctgtttgcaccaggcacctatttggctgctgcctggatgtccttctcaggttccagctcaggtctcttggaccagtcccctggtctggggtagggatgcctggaacggctctagcggcaaggtcatatctcgccaggctgccaggatgagctgagcattgtgtccacggtgggtgtctgaaggaaataatgtatacagtggtccatttccaagaccaagtgccttgaatcggcttaggtcagcaaactatagaagcaacaggacatactaggcccctgcttggatagctgctgcctgcttgtcggcctcccccttcttccctcttccccacccccttagttgccctcacccgaaccaaagaagtttagataaaagtttattagtctgcaagatagcttgatttgtctcttcttgtcagcctgcctagctacttaggtcataagtcaaacacttgaagagcccctgagctgactaggattgcaatgcattgtgagctgcaacaaaatgcagcaagacaaccctaaaaaaaaacacctaaagcccctacctaacaatcaataggcaacatccgggaaaattgtgaccccatagtactcagtctatgagcaactgggggagggacccgtactctagggataaactgcttgtcgaaactgctgggtgtgcttgtccatcagacacctgatcttgcaagttcatcattaaaagtttcactttcgctgttctctgggtatctgagtccattctttgggtttggacgggtaagtttgtttctcacatgtacaagccagaggtccatgagtgagaatcgggggccaaggagctttgtccatggggccgtaatgggatgagagggcagaggttatcaaactctgagggctggaggaagacatggtttctacctcttatctcatttcctactcatttagccttcggaggcaggcactgccgctatcccaccgaggaggagtctgacactgtgggtggtgaaggccacagttacccggtgagtagctgggctggactccacccttgctccctcctacaatcaacctcctgctcctcccaacaactttcctgaaaggaggcagtgaccactgtgcccttgcagcctccccggcaaccgacttctgaatcatcccactgcagagatctcattactgcagtgagtgtggctccagcctcccctcccttggctgctaatgagcgccctaatttgattgcctccaaatgagtgtgatgcaaaattaaaagatgccagaagacatgaccataaatccagtgagttggcttcaatttattatgtttgaattcaattagatttctcctccgatgttttccgaatatttatctagctgctggctacagaacgataactggaaggggctattactgtttaattccagcctcctccattcagcttgggctctggcaataccgttggatggaaaatctcagcctggatgtggggaggtcaagggagttcaaggtcagctgctgagccttctgccagccagccagcatatttcctgttggggaagggattcaaagcaatataccctattaaaatgttttaaaaatgatttttagtgcataaacactacaagggactccacagaagggagtgttggtgtcaaggcctttgttgtgtcacaggcagcaggggggatggggatctggggtctgggctcagcctggccacgaactttgtgtgacttgggaaaatcactaaccttttccagccttggcttctccatttgcaaaacgacggagttggactctgggaactgttttcagtggccctggattctgcactgctactctccttttagtttcagggtgtttgcccactctccttccccacccccacagccatgtgtcctgcttgaccctgggaacctgacttctttaagctgcctctcaggctttcttactgactgggcagaggttggaattagccagtgggagactctagctggaaggcaaaagtataggaagagagagagtggtcagtgtatccccccaccccgtccccactgcccctccccaaggctgtgtctctccaagacatcagctcctgctggaaaccccttctccacatctctagctcttactggctgtggcaacactattcctctctgtctagccccatgagtaacagcatcctagagttgtttgttttcgtgcttctcaacatccctgttcatcctcttcacctggccacacttctgtaaggactactgccattaaagtctcatcatttgaagcattcaatgccatttcttgccatgaccctgaacaatgcagatactaaatccatttttcgactgtggttttccatggagggctccccaggtctagaggggagctgagacaaaagcattcccggcttgggagcctgttgtgcagttggggaggtcccagagcaccaaggccaagctggggagacgttgtccctatgggcatggccaggcctccggcctcagggaggagagggagacggtgatcatggaggggaggccctgggagtgagaagctgggggaattgttccaccctgcccctccccccaacctccagagagcgaaagacgatgggatgtgggaggacggcaaaggggaagaggaagaggctccctgtcctgctgggtccttagccaagttggaagtgggagagtgagaagcccccatctagggtaaaggagtatgcccccaggggaggagagaaaggctgatgacacagagggctcatttgctctgaaatgggcctcccagtggaacagtgacgaagaggcagagtcagccgtggcggaagagcaggaaggagaggagtcccagagcaggatggagggagcatcagggagatgggtggatggccagggctggcctatggggcgatgaccaaaggttgcaggggtgggttcaggaatgagaccaatgaagtctcctgatttatggcttccagctttggtgtaagtcaatgacccgaatccctggagaagggtggggaatctgactctgaatatgtggcccaggagccctgcatgaaggagctggggcctgaagagtaactctgcattgagtactaggcttccaaatcagatcctggccagctgctgtctctgatggctcccagtcctcccctcagacccatggctgtaggccagactggcaggggcaagaggcaggagccaagtgggacatgtccagtgtcctggccaaacatacactggacgcagatgagccatatgcctgggaaacagagaaatggggtgaggccaggtcttcttgtgagaatgaatgtgccttactctctcctggagagagggtgatgacaagagttcattcattcattcataattgctttttgatttaagcaggcgagtttgttgtttaacaggctgggaacatctctcttttattgaaacatgtgacatagcaggttaaactcctaaagattcagcacagcagatgagaatcaaggagtttccttcttaaaaagcataacttgcatatgaatgaagatgattccaaattatgttttttccccatgaccctaaaattttatcccaaaaggagttatcatattagatattgatcagatcagcatttcatatcaaagctcaggacatccatctaaatatttaaaaatctttcactctcacagcacatcttgtgatcaatgtaaaacaaacagataggaacaaatcaaatatgagagaagggtttatggtgagagaaaacagtttctatcctctcccctccccagtcctggcctcactctccagaggcaacttcttgtaaacatttccatttttagtacttctggtgggtgcctccacaatgcttagtagcatgtataggcacccttatttttttattcatctggagaaaatttatctacctcctgtgatggaacataagaaatggcctcattatgcacctctgcttcctcccttcatccttccaaagttttatcattttggcataattatttttagttttctgttatttacttttaaaactttaaaccatataattgtactttgattctgcattccatccacctcagggagagtaacggtctggggcggtcaggttgggtctgttcccataccctccccttcttctgaaaggactctcccctccctcccgggggcctgtgcccatgaccagccagtcacagggccaggcatatgtcctgggccctggccactgtgggatacaggcatgctccccaatcttgaccactaggaatcctgcaggactttcactactaaaactgctctcttcaggtcacaacagtaactatcagttcaactacaccaaaggtttctgaagacaatggcttctccacccaagcaggttgtatataaattccaaatagaacttggcatcaccctgaaggaattctaacttcacactgttggggaaatttaccaagatagcttcagagtaaactaactttacacagcacattaaaacaaaagacatttattcagcgtcatgatcagactattacatttagcaatcaacagcatgggtgcaaaaaaaaaacctatattaaaacccttagctggaatgctttacacttcccacagaacagaaactaaaataacctgttatacagttagtcacaaatacagtcctcgagttttttgcccatacacatgagtatttgtctaaaacatgtcttctttgtagcagctaggccctgccaccactgtgcttggctgagttcacaaatctgtcgtaacctgtagattccctgtcatttctctggctctcctctcctgctaagctttgtttcctaattaaaatctgccactgccatagctactgctgctgctggaaccgccaatagccaccttggtttcatggttttgcaaagtataggcctccattgccacaggggccagagcttctgcctccaaaatttcctcccttcatgggtccaaaatttgaagactcattgttgtaattgccaaaatcattgtagcttccaccacctccaaaattgcttccatcattaccaaatccattacagccatccccactgccaccatatccaccaccaccacgactgccaccaaagccaccaagaccactgaagtttcctccaataccaaagttgtcattcccactgaaaccacctccacgaccaccaccaaagtttccagaaccacttcgacctctttggctggatgaagcactagccatctcttgctttgacagggctttcctaacttcacagttgtggtcattcacagtatggtatttctgaatgacaatcttatcgacggagtcatggtcatcaaaagttacaaaggcaaagccccttttctagccactgactcggtcagtcatgatttcagtcaccattaaaagggattacccaagcaaaatcatggaattattggttataaaagtaattgttggcacatcctatgtaacatatctaattgaataatggtaccagattaaattatagatgggaatgaagcttgtgtatcatccattatcatgtgtaatcaataaacaatttaattctcttgaaaaaaataaataaaactgctctcttttgttctgggattacctctaggaaggaaatgtaaagtcagctcttgtagggtgcctccaggcccctgacacgtggaaagatcgtgcaggagaaaaccaacccagaggtcagtggaggtggagaggaagttgtgagagagatcaagctgtggtggtgagaaaggcagctggtcctgctcactgaagcctccattgcttccggactgtcacagttacaccgacctgacaatttcagtattagcattagagaattgtttcagctttccaactaacacagggtgtattgtactccccacctcaggtaagatgagaattagcacgtaggctgcctgtgctagttttctgttgctgctgtaacaaatttccacaaatttatgatttgcttagagcaccacaaatcttagttctggaggccagaagtccagcatgggcctcacggggctaaaatcagtgtcacagggcagctgtgttcccatgaggcggctgtgttcccataaggctccgggtggagactgtttccttgccttttccagcttctagaagctgatggagttccttggccagccactttctccctccattgtcacagcaggtgtggcttcactctgacctcttctgcttctcccttccaccgaagggcccctgtggttacattgggtacacctgggggcttagcctgtctaatattgccacaccctcttgtgaatcttcttttttcttttctaagagatggggtctcgctttgttgcctaggctggagtagggtggtgtgacggtaacaaactgcaggcttcaattcctgtcctcaagcgatcctcctgcctcagcctcccaaagtgctgggattacaggtgggagccacagtgctaggcctctcatgaaccttgtcttccagaaatgtgttggactctcatccattagtaagccatctttctctcttttttaatgcttttcccttatagatttacttcattttaaatttataagcttaaatttcagtgatgatgtcttaggaagaacaggagaggaggaacaaaggaacaaacttctttaatgggaagctgaaaggacccttttaaaagtgtgcagtggagagatcctgggcttggtctctggtaaacctggtgaatggtgggttaacactccctccctcactcggtgttgctgggaggataagacagaacatgtggcgagcaggtgtccaatagctgcctcttgctatgtgcagccagtgccacatccaggctgagtgctgtggggagtgtggctcatcccactggggccacccctggcctcgctcactggagactccagaatcagggctgactgagcagcttgtggcactgaagaatgttctaggaaaggaggtgtgtcctccttggaaggggaagcttcatggtgggtgagctgagggtaaggggtgggtgagggccatttgaagagtcacctcccctacattcttttatcttttggagcctccatccacgccacttcaaacaatgaacacacacatccaagtcagtaagtgcactttgtgtatatctatataagtgatgcgcaattactgtataacagttcactagctgacctgacattattcacatatcgtaggcatgtgactaattgtaggtgtgtaatgaagtgttcacatcttattacatatttaattcctaaggcatttctacagttttatttgagaattttggaactgccagtgtgtttttcatgtttcaaaccttttcacaggccctgaaaaaacccaaaggccttatattctgggaccgtaatggacaaaacagccctgggaagtatgcttgggaggatggcgaaggctgggtttgctgagggaggtgccagctaaggtgctgggcacaccagaggcaagggatctggaccacaactgtcagtttgatgaacacactaatggtggagtgacccccaccaggagtggccagcaagcagggtccaacaggaaagacatctgggaggccagcaggtggaatcctggctctgccaccttcgtgctatgtgatatcagccaagttacttgccctctctgattctcaaatgctcggaggccctttgacctctagagtctatgggacctgagtgaccacagggctctggtttgttggtggctgcctctttatttaactccttttctcaaatacggtctatgggctttgcttaaagtgaggtgtcctgtgcacactcttctccatgactttgaggccgtgagaaggcccgccctgcagaaggactgaggaaactagtgctggagtctcctttcttgtatcagtgaaggaaggggagagaggagataaagtgctcaggttacagaatgtgaggatcgtgccccttttttccaactgaagacattcctaggcattttatctcccctgttgcaacttctaaatcacaaaaaccttatgcatccagtttggctgacatccacctgcaatgggagtgagtgagattgagccactcctcaggtgaatggaaaattaaggccaaccaaggcccaccccatgccccactgtggggtctaaaaggagcaggcactggcctgctttctttttccctaaagaaagctctttggggacccagcagaaacagcagaggtggggatgcgagcttccgcctgcatttgttccagggtgggccagtgaggatttgggaggaatggtgtggaaaggccctgcccaagaaggctggatgctggctggggaatgcccagggtgccagctccctaccctggggaaaggccaggctggcatatgccggagccagggtccaaggtcacagagaggccacacctgggcacccctcccagcaagggaaggtccaagctgggaattacttctctttggaaagtgaggggagtggtacagaaatagtgctattgttgctgttgtcctgtcacttctggcattggaaatggtgttgagcttctacgtgacgggcattggaggtcaaacctgaaacaggtgaggcccatccctttactaggctcacgttctaggtagggaggaggcaggtacctcctccacctaagaaacaacaagagatagagaatgcagtaactgtcctaaagagaaaaaccaggggatggagagagaataatggttgtcaggacgggtcagactttaggatggtaaatgaggagtggtctctgagaagggatgaggcagaggaagtgaggctcagggaagtgaagcacttgcccaaggcagcctgctggtcatggcagagctggcaagctcattccctcctcattatgtcaaccttctgggaccagagtctgggcagggcagaaactactgcaccaggggtgcgtggctccagcagagagagacaaagtgccccatgcaatccagaaactgagccctctgggctcaatcttcaaaggaatgactctcagagttgtgtcccctgccttttcttcaccatggaacttttcccagctccactctggtgggcttggggacaggacctgccctctgcaaagtgatgaccaaggataagtcggattttcaaggagaccttggagaacaccaccctcttattgtgcaaaagaggaaacaggtccagagagggtgagccattttttcagcatcacacagctgacctggagcagagtttcctaaaagctccctcggtgctctttcccctgctgtggctagacccctccacaggaacttaacaggaacccaaaggaacgagtcactcatggcagaatcactaatgtgatggagggcaggagtgagagacggcataatgtcaatgctggcacactcctggcacacgggaagctgtccatgagtggttgcttcccaccacttccatcgcccagtttgggacatgtctgagatccagtgctgagcccagggtctagcatgtcatgggagctcaggagttcctaattgactacatgaatgctaaggtgtgggatgtgctccttcctgctttctcattctcaaagaacactcttatacacctggttgtggggagggtatataggcaatcaacttttgcgtactcacttccattgtaggatcatgcatgcatgtggacgtgcgcacacacacaaacacaaatgcacacacacacacacacctgccttctcaaacttgtgggaccagaaaggatgctgcaaggcctaagataataattgctggtctcttttttcttatgctttagcaggaaaaacacactcttccaagcacacagctgcagaggtcttcctgagcatcatgtagtctttaatcatgttgtggaggacaggatgatctgtgcctcaggaatcagcttagttgataactcaattccatggctgggccccatttgtaagcagtcatggcacatcccatggaaacctataatctaattatggctgctgcatcagtcctcatccttcatgctgtcatccacagctcctcaccacccatcttacttggatgaaggctctctgaggtatgaaggacaaacatctgatccttccacttgaggcctaggctgctttccttattctcacagcagccacaagtattgggatcacagcttgaaaggctcttcttggtccgtgggactgaggcagtcaggacaatttcaggcctttagtgaatggaggcatttcattacttcagatctcacctagtcttggaggtcttgggcatttttagaactcacccagccaggctgccactcagggtgaggctacctggattgtttattggtaacgaatgtttgaatcagagaccgttagaaaaccaaaaatgaagattttaacaatacaaaaagcagaacctaaagaggtttaatcagtaggattggtaccagttctttgtatgtctgatagaatttagctgtgaatccatctagtccagggctttttgttgttgtcgttggtaggttttttattattggtttaatttcagagcttgatattggtctagtcagggtatcagtctcttcctgattcaatcttgggagattgtatgttcccaggaatttatccatttcctctagattttctaatttgtgtgcatagaattactcacagtattttctgaggatcttttgtatttctgcatgtatcagtatgccatactgttcaagcacatggactttgcagttggacattcctgagtacaaattctgcttctggcagagcatttaggtgacttagtctgctgactaagctgcagtatcttcatctgcaaatgaagatgaattgtaatatctttgtcatttctcacagtacttatttggaaattcttttttctttgttaatctagctagtggtctctcagtcttgtttatttttttgaaaatcaacttttggtttcatttatcttttgtatggatttttgcatctcaatttcattaagttcttctttaattttagttatttattttcttctgctagctttggggttggtttgctctttttctctagttcttctaggtgcaaacttagactgttaatttgagattgttttaacttcttggtgaaggcatttaacgttataaactttcctcttaacactgctttggctgtatcccagagactttgttaagttgtatctccattttcattactttcaaagatttttttatttctgccttaattttgattttcacctaggagttaatcaggaaaaagttgtttaatatccatgtatttgtgtagttttgagagatcttcttgatattagtttctatttttatcgcactgtggtccaagagtgtgtttggtataatttcaattttttaaaatttattgagacttgctttatgactcagcatatggttgatctgagaatatgttctgtgtacagataggaagaatgtatattctgtggttgttgggtggagtgaatgtctatgaggcccctgtagataaaataatagctgaaattagaaaaagaggtttaaccagctttactcatttaaaatgcaaatgtgctattagataagggccacatcacttggcatcaggccataagacaagatgtgtgtggattatcctgggattaatactcatttccaaacttctaggactattgagagttgttttttttttctagaaatctctgatggactacatttgttccatagttcagcctcatcatcttatgaactatttagataagggatagaaagtatcttttgaattcatgtcagcaccaatagattggtggtcgctgctttaaaaactgggcctagaaggattctgaattcttaactgggcttagagcgaaagaatgccatgttcaaagaagaaagttatcaatggctgcaggaggggtgaggtggcccatgtgtcacatgacttgctatctttgcactgggcaaccctaacctctgagagggtccttgttgaataagataagtaggtccagccctcaagttgttatcagtatagcagagatggtgagccacgaagtgctgccagatcactgtattgtgttctggtcatggcaggtgcatgtatcagtatgccatactgttcaagcacatggactttgcagttggccattcctgagtacaaattccgcttctgacagagcatttaggtgacttagtctgctgactaagctgcagtatcttcatctgcaaatgaagataatacccacctcacagggtagctggggtcattaaatgatatcagatttcaaagcattagatgctcaccttgtagtaatcattattactataattactgttggtgtggaaacacagacacgcctctaaactgtcctgggtacagagaagtctctacagacaggccctgttttaaattgcaagtgatactcaggcagtcttcagtagacaaaggcagaggccattcagtgcaggggaggacattctgtcccctggttaggaaacctgaactatggaatagaaaaaaacttagactcaatattcagaacaactttcctgaaataaaggaagacttgaattttctgaccgaagggtaaattgatttagagaagtcaatgctgagatgacagatcctaacaaaatgaatgtttgccttcaaagaaaagaatcctaggagtatccagtagaaaaccatctctccaaaaaccaatcaagacaacaacaaaaataaaaacaactaccccaaacaatcacatgaaaactcaaaccaagagaaacacttgcagaatgtcagaataaggacttctgaaaatccttccttaacaacaatgagagcactggcaaaaatgtcaaaattaacattttcagagtcctggaaattaaccaaaggctttcagcaatccaagttagatttattcaagaaacacagctgaatctcagtaagaatagcaaattttgtggtgttttaatttgccttattcgtagtcttcttttccaagctctatgatagacttgaacataaatgttctcagctaggcatggtggctcactcctataatcctagcactttgggaggctgagatgggaggattgcttaagtccatgagtttgagaccagtctggacaacacagagacaacctctgtctttacacacacacacacacacacacacacacacacaattaacattctcacaaccatgacagctgtgaaaaccagcagcctggtagccactggggaggacagaataggtttaaagctctccaaaaatcccatcctcagaaagttgttactatttgatctgtctgacagctccctggaaaagacacattcccagggattgtctttgcttaacatggtttggagcttagtctgtgtgaacagccctatcctgagggaatctgtcaaaaacaatcagcaaaaattgtttgacattgcaactgcctgagatggcagtaccagttggggctaataagaggctgaccaaaacagttacaaggaaaaactggggaatgaggtattcatagaggctttggaaaagctctgacatattcttaagaacctagaaggccatgtgcacgtgcagggttgtacacatgtccaagacagatctaactagagcttaacttttgtttggctttgaggctctgtgcaagcaggaagtaaactctgaggcagagttgtcagctgcttgctgaagcatcgaaggcatggctcaacacaaacaaagcttcccagcaaaggtaggtagatttagttgtgcaaggaatttaaagaaatctctgtccaaaaattaatggacaactaaactgaggaaagacttcggtggctacacatgacaaaaagtatacattaaaacttagtccaggaaattcactaaacagagaaacagcagcatcagcaacaacaacaaacagaagcaacaacaaattgtgaagaggggtgaggtctgatttttggagatgccacattattttatttaaaacattcagtttttaagaaaaaaatatgagaaatacaaagaaacaaaatgtgtgacctattcacagggaaaaagctgccattagaaactttttcttgaggaagcccagacattggacttactatcaaagattttagaacaagtcttaaaaacatgtttaaacaactaaaggaaaacatgtttaaagaatgttaaaaagcatgacaatgatgtcttaccaaatacagcatatcaataaagagatagaaaattatataaaaaagggaaaaaaataaaattctgggttgaaagtgcaactgaaataaaaaattattaaccagaggggcttaacagccaatttgagcaggcagaaaaaagattcagtaagttgaatatgggtcaattgagattatacaatccagggaacagaaagtcaaaagaatgaagaaaaatgaacagagcctcagagagcataccaatatgtatataatgagaatcccaaaagaagaggagataaaggggcagaaagaatatttgaagaaataattgccataaacttcccaaatttgatgaagaacattaatttacatgctcaagaaattcaacgaactacaagtggtataaaaacaaagaaatccatacctagatacatcagagtcaaactatcaaaagccaatgacaaaaagagaatctcgaaagctacaaaagaaaaataactcagcatatacactctagcttcaaattcctcaataagattaacaactgacttcttatcaaaaccattcaggcaagaaggcaatgggataacatattaaaagtattgtaagaaaatgactgtcaaccaagaattctatatctagcaaaggtatctttgaaaaaaaagaagaaatgtccagataaatgaaaaatgagagagttcatcatgagtagatcttccctacaagaaatactaaaaggagtctctcaggctgaaatgaaaggacactagatggtaacttcatccacacaaagaaataaagagcactgcagggtaattacataattaaaaagacagtataatgtatttttaattgtaattctcttcttatcctatctgatttaaaaatagctacataaatgagtaattataaaactgggttgttgggcttataatgtataaagatgtaatttgtacgataatattaacacaaaggaagggggcaggaaatggacctatattgaagcaatctttaaatatattgttgaaattaagttggattgatatggattagattgttttatgataaaatgttataatccccagggcaagaataagaaaataactaaaaatatatggtaaaacaaacaaaagaattaaaatgatatgctagaaaatatcaattgaattcaaaagaagacagtaatgagggaaaagaaaaacaaaaaagatgtaggacatataaaaatagcaaaatggaaggtgtagagcctatcttttcagtaaatcatattaaatgtaaatagagtaaacataccaatcaaaatgcagaggttgtgattttaaaaaatgaatcaactgttatctataagagacatactttacattcaaagacacaaataggttgaaagtaataggatggaaaaagataatccatgaaagtagtaaccaaaggggagctggagtggctagttatactaacagtagaccaaatagactcttaagacaaaaattattacaagagacaaagaaaaacattttataattgtaaaagtttcaatctattaagaagacatggcaattaagaatatatatgcacttaatagcagagatccaaatacatgaagcaaaaactgaagtgagaaatagaaaattcaacaattatagttggagacatcattactccactttcaacaacggatagaacaactaggcagaagatccacaaggatatagaagatctgaaaaaaacagtaaacccactagagctggtagttacccacagaacactccaccaccatcaacagaatagacattctttatatgtgtatatggaatgttctcaagaataaatcttgtcatgagaagaatagtggcccccaaagatatccatgccctaatccctggaaccacgttacattacatgacaaaaggggctttgcagatatgattaagggtataaaccttgagatgcggagattaccctggattgtttgggtgggcccaatcaaaatacatgagttcttaaaagtggagacactttcctaaccatggtagggagatgaaatggaaggaggaggagacaattgaggtgtgagaaaggtttaagtgactactaaactgatggacttgatccaccattgctgcctttgaggatggaggaaggggactattaataagggaatgtgggtagcttctagaagctgggaacagttcagctgacagccagcaaggaagtgggaatctcagtcctacaacttacaggaactgaattctgccaacaactcgaatgaacaagggaactctccgagaatttccacaaaggaatacaaccacacagattcctatttttagcccagtaagacatgtcagacttctgatcttcagaaccacaagataataaatttgtgttaggtgcaaatttgtggtaatttgttatggcagcaatagaaaacacatacatgtatattcatccataaaacaaaatgcagtaaatttaaaataattgaaatcatatagaatatgttctctaacaatagcagagtgaaattcaaaaccaaaaacagaaagaaatttcggacatccacaaatatgtagaaattaaatgacacactccaaaataatcaatgggtcaaagaagaaatcacaatgaaaattagaaaattatttgaaatgaatgaaaataaaatcacaacatatcaaagtgtatgggatgcagtcaaagcaatacttagggagacttttatagctgtaaatgcctatattaaaaagaagaaagatctcgataacccagacttccaccttaagaaagtagaaaaggaagcgcaaactaagcccaaagcaagcagaaagaagaaaataataaagattgtagtggaaataaataaaacagggaatagaaaaaacactaagggaaaaaacaagagtaattgcttcactgaaaagagcaataaaattagtaaacctttagcttgactgagaagaaaaaagttatgtgccctatttcattccctatacattaaattattaaattattaatgtatagggaattaaattattaaattaataatgtttagagaatgaaatagggcacatcactaccacctcatagaaataaaaggattataaaggaatactataaacaattgtaagacagcaaaattttaacttaggtgaaatggaaaaattcctagaaagacaggaactacaaaaactgaatcaagaacaaatagaaaatttcaatagaccttagtaagtaaagggattaaattagtaattaagaaactcaccatgcacaaaaaagctcagtaccaaatggtttcgctgattagttttcccaaacatttaaaaaagattattgttaattcttcacaatcttttccaaaaatagaagaaacaaacttcaactcattctatgatgtcattattctcatgataccaaaacaaaagacattctaagagaacacagcaatatctttcatgaatattaatacaaaaattatcaacaaaatactagcacactaaacctagaaacatataaaaatgattatgtatcacaatcaagtgaaatttatttcaggaatgcaaagttggtttaacataataaaataaatctaattaatacaccacattaataaaatgaaggataaaatccacctaatctcaatagatgcagaaaaaacatttgacaaaatcaatatcctttcatgataaaacactcataaaactagaaatagaggagaatttatgaaatctaataaagaacatctatgaaaaaccacaactgacatcatcccaaagggtgaaagagtggatactttccttctaagaccagtaagaaggaaaggaagtccatgctcaccacttctattcaacattgtattagagatctgagctagggcaattatgcaaataagtatgtaaatttaaaaaatagcatccaaattgaaaagaaagatgtaaactatatttacagatgacataatctaaggaattcacaaaataactattacgactaataaatgagttcagcaagattgcagatacaagaacaatatgaaaaacaattgtatttctacacactagcaatgaataatctgaatataagattaagaacagaattccatttacaatggcatcagacaaaataaaaggcttatgaataaattcaacaaataagtctaagacttgtacgtactgaaaacaataaaacaccactgaaggaaattaaagaagacctaaataaatgaaaaaacatcctatgttcatggatttggaagacttaatattgttaagatgtcaatgtttcccaaattggtctacagattcaatgcaatcttgattgaaagattgtgtgcctttttctcagaagttcacatgcagatgcaagagacccagaatagccaacatgatcttgaaagagagaggactacacttcctgatttaaaaacttaatacaggttgggtgcagtggctcacacctgtaatgccagcactttgggaggctaagttgggaggattgcttgagcccagagtttgagattaacctgggcaacataatgagaccccatctctacaaaaaataaaaaaagattagctgggtgtggtggtgtgtgcctgtagtcccagcaacttgggaggccgaggtgggaggatcacttgagcccaagaggtctatgatgcagtgacctatgatcaaggcactgcactccagcctgggcaacagaacaagaccctatctcaaaaacaaaatgaaacaaaacaacccccccaaaccccaaagaaaaccaaacttactaccaacgtctaggaatcaagatagcccaatactagaaatgtaatagaattgaaaatccaatattaaaccttcacatttatggttaactgatttttgacaaaggtgtcaagacaattcaagaggattaaaaaaaagccttaacaaatgatgctgggccaaccggatttccacatgtgaaggaatgaagctggacacttaccttacatcatgtacaaaacttaactcaaaatggaccaaagttctaaatgtaagagctaaaactataaaaccatagaggcaaatgttcatgaccttggattggtaaaaggattattagatataataccaaaagcagaagtgaccaaacaaaaaaaaataagtggggcattatcaaaattgacagcttttgtgcttcaaaggacaccatcaagaaagtcaaaaagcaacccacagaatgggaagaagtatttgcaaatcatatatatatacatacatatatatatatatatatatatatatatatatataaaatttgataagccacttgtatccagaatatatgaagaactctaacaattcagcaataaaagacaataacctaattaaaacatgggcaaatgatttgaataaatatttgtccaaagaagatatactcatgatcaaaaagcacctgaaaagatgcttgacattattagtcattaggaaagtgcaaatagaaccgcaataagatacaactacacacccattaggatggctttcatagaaaaagacaggcaataagaagtgttggtgaagatgcagagaaattgaaaaccccgttcattgctggtgtgaacataagatggtgctgtcactttggaaaacagtttggtagttcctcaaaaagttgggtgtagtattatcatatgaccaaggaattccactcctagatacatacccaagagaactgaaaacctatatccacacaatatcttgtacaagtgttttcaaagcagcattattcataacacccgaaaagtagaaacaatccaaatgtccgtcaacgaatgggtaaacaactgtggtattcctttccagtggtaagagacagaattgattagggaaatgaggcagattcactaaactccactgaaggatggacctgagccaacagttcacaggaaaatgacacaaaaggcctttaaatatataaaaagcatcatgtttaaagcttcacttgtcatcatgggaagtcaaactaaaacactgaattactatactttgtccaccagatgagtgaggatcaaattttgaagatgtactgtcttagtaagaggtttaggaaattggtattttccttctgtactgatgagaatggggacttcttgacaaaatctatcttaagtacaattccacatgccctttgatctaaacacaatattttaggagtctatcctatgatgatacaaagtaatataagaatgtttattgcaataacttccaataacaagctaccgaaaccagcctaaacaaccaaaaacagattaaatgagtagagattggttaaataaattatggtacattcacaatgaaatcttacactgctgttaaaaagtattaatttttcctaaagatatattaaatacatataattaaaaatagaaagaagactagcattagacaaaagctagagaagtagggaaagtacatatatttttgcgtattcctagagaatttctagaagcatatacaggaaacttaacaatcgtgagagagtttggagaggactttggctgggggttctggagtggtgcagagatttattttcaccacttactcttttgtactacttgattttctagaagcatatgcaagatgaatttctagaagcatatacaagaaacttaataactgtgagagagtttggagaggactttggctggggtctctagagtggtgcagagatttattttcaccatttactcttttgtactacttgatttttatcaagtgcgtgcattacttttttgccttttaggtttttattttatgcatgtttagacttttaaattttcaaataatcatagattgacaagaatttgtgaaggggtcccaatatccttcacccagtttctccactgtttacgttttacattctacaaaacaatatcaaaacaaagaaactgacattagcacaatgtgtgttcttctattacattgtatcacatgtgtagattcctgtaaccaccaagacacaaaactatcccatcatcccaagatctctcctgctacctctttgtagtcacacttccccaccaccgcctctaacgcctgccaaccactaatctgttttcactgtttataattttgcccctggaagaatgttatacaagtgaaatcgtacagtatgtgactttttgagattggtttttttcacttagcctaatgctcttgagatccatccatttagttatttgcatgaataatgtttctttttattgctgaatattggcatagatgtgtcacttagtttaagcattcacttagtgagggacattttggttcttttctagtttctggctatgataggaagacacaggagaaaatcatctggacctaggagttgaggatgagttcataggcatggcacccaagtacgattcattaaagaaagaattgataaattggacttcatcaaaattaaaaactttgcctctgcaaaatattctgttaagatgatgaaaggacaagctatggaggggagaaaatatttgcaaactgcatatctgacaaaggactcacatttacaatgcataaagagctctcaaaactcaacagtaaaaaaaaaaatctgataagaaattgggcaatagacatgaagagacatttcatggccgagtcaaatcagcatgtggaaatatatttaacatcattagcctttggggaaatgcaaattgagatcatgagaaatcactgcacacttatttgagcagttgaaacaaaaatataatgataaaaccaaatgctagcaaggatgcagagaaaccaaatttctcatcccttgcttgtgagaatataacatgatacacacagccactcccaaaaatagattgacagtttctcaaaaaacatgcacttaccatattactcaacaatcacattcctgggcttttatcagagaaattataatttaagtttgcacaaaaagctacacacaaatgctcataactgctctattcgtcatgtttttattggcaggtaatttacatacaaagaaattcaaaaatcttaaatttcacaattcaatgtgttttgtcaaatgcctgcactcctgtccctcccccactgtaagatttacaacactctagcacccccaaaaagttatttcatgcccccttcagctaacctctaccatgccactccatccataaaccccaaagcaactattaaaaaaaaaaaaggcaaaaaacgcaattactttcgcaccaacctaatactagtctgatttttaaatcacagattcattttcatataaatggaatcatacaatgtttattctttcatacctgacttctttcattcaggaacacgattcagagcttctgctgtgcagtagggggcatcagtagttcattttctttttattgtctgctaacattccattgtatggattcaacctagtctgtttattcattcttcttactgatgaagttttttttttctcacggcttaagtccaaggtgtgtctttttcatccagccaggtggccccggcaggtcgctcctcagggacccacatgggtcagggcggtgcagcagtgacccacaggggccagtgcagttgaagtggctttgaaacctgattggagaaacagactgctcagctgttaagaacacacagcgctccagaaaactggtgttcaacacaacgcgtcactccggcttccactgctgctgcggagagtcaggttctccggcaaggccccgcgcgcccgcccccgcgcgcccgcttctctgtccagggaacgcctttctgcggccggaggcggctacgagggggcgctgcgaaagcggatttccaggcacgcctggcgccactaagcggcgctgagacggcgctgcctcctgactgccggttggaggctacaggggctctggggcaagggccgcttttaggagtttgctggtcacgaggggggacgcgacctcgtccaagatctgtctgcaagggacccttcccagccgatgtgaacacagcccggggaaaggggccgtccggggagcacaggcagcccgggaagaggagtaggggctgaaaccaaaggcagcctgggtacccaggttttcccaggggacaagtcccccggttagctgggcacagggaggcatggagagcggcagcaactgcgttgggatggggcggctgccccaggttggggcggtgacccatgttccaccaggccaggcgcagggctgaggtggccgactcctgtttcacaagtgaagacctggttaccccagcagcaaggcattccggagtgggagaattcctgagtcctggggaggaagccgtggttacagggctgtggccctgagcaggagctggctggcccagcagggtgggccaagcacttcagtcaaggctgagcgccaggcaccagggactcaggtctgagagacctgatgtacatcctgctccagagcagatcacagagatgtgcccgcatgaatccccaggctaagcccagaattccgtggaagatgcccatgggccaggaacacgggtagtcaccgcgctagggcatcacacagggccccccttggccaaataccacgagggaacttagacacctgcatggggccatggaagtgcctgcaacctcacactcaggcctagggcttaccgaggtattgcagatatttgtgttctcagagtaggagcttaggaatcagtatcttctcttcactacagggacagagatgcagtggcctaggacacatcacaaatatttaaaacgatgtccttggtcaaggacagaggtagccaaggccagccttctcccaggaaactaacccaggaccccaaagcacagagctgttaggtgggagggaattggtctgtatgtctccctatagtgttgcaacacttcggcgctgggctccctgtcccagactcaccttccatactcaagccagaggcctacgaaagccgggttaagatcttcccctgcctgtccctgtaaagcttccccactgtctctggaaatcgtttgagcttcttagccccacagcatgagcccgctctgactcaggccctgacaagctctttctcttctgtctctccctcctctgttgatatggacacaccattcctttggcatgtctagtacagaccagatcccctgctgttgttagcattcctccctctccctggaatgttcttccttatctgtctacctgataagcactgagtcatcctgcaaaactctgcacagctttcaccttccctgaggagcctcccctggccagccccaccctgttgcaggcagaatgcttggcggtgggttgctgaccacaaatccattccccctttattccttgccaagggaatgctgattttgctcaggttgtcaaccctcagggaggtgaccctaaacatgccaagtccaacacactagctctaccccctgagagcatgagaacaacacggatgggcatgtgcccggatctggctttgccctcatggactgcaggtcaggggtgggaagctcttatagagcagccccaggagccctaggggccatcctgctggccatgccatggcagtgtcagaaccccaaacagcacctggggtgaaggagctactgaaagagtggagagactccactttgtcctgttagatctgtctcagaagtatttttattaggattgactgggtaagctttcttccacagggagcctaagggggcccagagattcttctcagaattggaggccatcaaggattggctcaggctcgctggctactaggctctcctgttcccaaagtccatactcttgtttgttgttattcaaaaatatttgttgaaagcctgctatctactaggccctgaatgtttaaaaacaaataaagttcctgccttcaaggggctcacagcttttctgagaggacacgtaaacagataaaatgtcattagggtgtagttctgtgtaatagagggtgttcttaggtgctgacaagagcatctactctgtagtttaagcagaaaacaaatgtatgaaaggctattggacggctcacagaattctgtgcggcacgaacactgtgtctcaaatcatgctgcaggacaaacttggggctcagtatgctggaccatgttgtgccttctctcccagccagtgctgcaatggaagaaaaggaattcagctcctaggaaatgcaaaacattgatctgaggatagagaaggagtatatgtagatatcatctcttggagggaattaaaaagcaacgatgatagagctatggcaaggctacaggtagggaatacctatggcaaagaaaaaccagagctagacgataaagtagtaaaaccagattttattcaggactattgcaataagcgaaaagagacctcaatatacagtcaggctcattctaaaaacagcatgagaagttgagacttggagccatggagcaggtaggagttgaaagatggaaaattaccaagaggaaatgccaggggtgagggtgatgttggctaaactgacctaacaggagacctgctgaagaaaggccagggtgaccagacatcacctgggaaggtggaggatgaggaccctgatcggatattgggagtggtcagataggaacaaggggagttcttgctgaattgacttagtgggattcttgctcaaattggattttacaagaaagtacacagatgagcctagaaggttcaggagcctgactcaagtttgctcaagcaaagaaactttgtcactattcccttatttttcccctatgctgaaattaaactgggcagactccaaattatctttaaaaacataggtgtgtttttaacaaattccaaagagcaattgcaaaagcacctgtggagcgtgtctgctttaccagaagtgcccaaaaggttactccagcaaaaatgattagcaggtgctgtggatgctgctggtgtcctggccagggcccctttgcttccttccccaggtgccatgggggtcacctggtgggagtcagcacatggggccgtgaccccttacacccatgctgctccagctctgaccccaggcagagagagcttcccctctaatctgaggagacctcttgcttccaggcctgtcccacatttctctgctggcagggaggcagtgggggtgatgtccattctgccccatcaggggagatgatcaacttcatgactctgcttaagcagatccccttgctgggcatgtacttggacttgaccaaatttccttggctgcagctcttctcaaggctcctgtttggccacatgaggcctgttttggggtgggctgcaaaagaacccatcgaaccagtggtcaggggagcttgcagggcagagagatcctctaagtccttccttccttccttcctttctttcttctttcttttttctttttttttttttttttgacagagtctcgctctgtcacccaggctggagtgcagtggcactatctctgctcactgcaatctctgcctcccgggttcacgccattctcctgcctcagcctcccgagtaagctgggactacaggggcccaccaccatgcccagctaatttttttgtattttttagtagagacagggtttcaccgtgttagccaggatggcctcgatctcctgacctcgtgatctgcccgcctcgttctcccaaagtgctgggattacagactgagccaccacgcctggcccctctaagtcctttctaaagagctttggcagaaagcagctaggcaatggctcagaagtgaaagcaagtctgcacacaaagcaggacttgaactgaaagaaaaggaataagaattctcacccagggctgggatccaagagacgcacactgatacaactactaaaaggttgttaaactcccgaagggcccctgccttgctgtgttatagtctgattgtgtattgttgaagcccttacccccagtttgctggtgtttggagatgagcctttggaagctaattagggttagatgaggttatgagggcggggccctcatgatggtatagtgatcttatgaaaagagcaggagagagagagagagctcttccccccgtgaacacgtgtaagcacagaggaaaggtcatgggaggacgtgtcaaaaaggcagccgtccgcaagccaggaagaggccctccccaggaactgaattgatcttagacttcccagcctccagaactgtgcaaaataagtgtctgttatttaagccacctatttatggtattttgtatgtcagtctgaaaagactaagacatgttggtgaatagctgctgcacccccaacacccaggagcctcccctggggccccacagacaccctgccatccagcactaagggttgaggcctggccctgcaggggccgatactcgagctctgctccacccctgcagacagcagccattcaggtgagtgggttgtgctgcaccagttgttaaatattctgagcaccacttgtggtggatttaaaaacagcccccagattcgttgacactcttctcattgacagattgggtctgtgtcccctttccttgaagctggggtggcttgtggtgtcttcaactgatagggcaccggggaagtgatgccatgtgactcctgacgctaactcacagaaggcaatgtggtgtccttcttgtccactgggagacggtggagccctaccacttgctaccctgaggccaccatgctggagaagctacgtgtaggagcgcaggggacagtcccagttgagcctggccttccagccatctcaccaggggcccaacatgtgagtgaagaggcatccagatggttgcacccctctgccctagagtcaccccaaccttcaggtcttcccaactgagactgagtcgtcttacttgttgggtcagagacaagcaccttgctgtgccctccagaactgctgacccacagaatctgtgaacattatacatgaggattttatgctactggctctggggtggttcgaaaggcagcagttgtaactgggagcccaccctgtatagaaatgtgaggaaactgaggctcagagagagagtaagtgactcagtcactgatatagtttggatatcccctccaaatttcatgttgaaatgtgatccccagtgttggaggtggggcctggtgggaggtgtttaggtcagggggcggatccctcatggcctgatgctgtcctcaccatcttgagctctgacaggatctggctgtttaaaagtgtgtggcacctccccccacctctcttgctcccactctcgctacgtgatgttggctcccccttcaccttctgccatgactgtaaggtccctccagaggcctccccagaagctgagcagatgccggcaccatgcttcctatatagcctgcaggactgtgagccaattaaaccccctttttaaataaattacccagactcaggtattgctttatggcaacacaagaatagcctaacacagtcaaagtcatggagctggtgcagggcagagccagaatctgcctcccgtccaagtgaattcagagcccacgctattcccatctccctgatcaggctggttcctgggcacacgcttacccctcagggccacttgaggggaagtttgcaaactggagcatgttcaggggtgatggccccaaacaggctccaggagggaccactgaagggactggggacactgggctttgacagaggtcatcacagaatttgtgggccttcttcagatatccaaaatgttgttactgggagggaataagtgttgtggccctagatggcagaggtgtgggcttgatgcggctgattttggttcaggtaaagcaagaactttgctggtcacatccattggaaaaagattgggctgtcaaaggacgcagtgagtcccatctttggaggcagccaagtgcacccggagtactcaactgcaccctgagtatcaccagtacaccctgagtacccaagtgcaccccaagcacaccaaggaccacccctgggtggatgccaagggggtagtcaggccacaggttggaacagcaccagctgactttaaatccctctctaaccccgagatacaaggatgtagcctacacatcaggaggtgaatagaatctaccctcatttgcaagagttgtccccagggcagcggtggctgcagcccatccagtgttcccactgggagatgcccacgaggtgctcaggtacagcccatccagtgttcccactgggagatgcccacgaggcgctcaggcttcgtggctccccaaagctctgtttctgacaaattaaattggtcctacactggtccctgctaaacatccaaagatactttgagttgaatacaaatctttattattttgaaaaccacagcaaaggcacttcagaatctccaggtacccagtctcagttgccgttcagtggggacaagagtggtgctgagggcatggtcacacccttctgtgctgcatgcagaggggtgcaaggccagggcagctgacctggtcagccaccaggggagcccacgcctcttataacacagtgtccttgggtcaggaatttgtagtttattttgttattaagatggcgagagaatttttcgtccatttagagcctaacatttttagatgaatgttaatggcatctcggttgggatggattcgtgttcgtttctcagctgctgaaggatgtgtgttctaaaacaaaagggctcccagccagctctccggctgcatgatagagaagtgttttgtaagacgcttgttaaaaacccatattccctggcccctcttgtggagaccctgtttcagtagatgggaatggggctggggtctgtataacctgtgcccaggagactctgtgaccagcttgggaagctcctgcagggaggaaggaatgatccacaagtccccaagcccttcatgctgaggcatctgtctggctggagaaacactaaggttggcattgtgctcacactgggaaatgacctggaggaagttgggaagaggagtccaggccggttccaccctctgggtcagaaacccggctggaaagcactggaaatagggaaatagaagactgaaaggctgggacccccctcacacccaacctgcgtccatggccgaggttgagtgaggagtcctggagactctggcttcatggtctttgctcttgttcttctgtgcctcaggggtcgctgcccaccaggctcagcagggcgttcttgtagtcgccgctggtgtcttcctgtgggcaggaggcgcataagcgtgagaaggggtttgcttgtgcctggctcggcagtggcggctgtgttattatgactaagaggtgtgcccctggcctgcacctggcccggccctccagggttcctagccgcaggggttgtgccatcacccctctttcctggtttttaatttcaggctattcctttacatttccttttgattctcttaccaactacatgcaggattgatgtggaaaatgaatcagagacagttccactcctaaacaaggaaggggtcagctgtcccagggttcttctattcgggagccagggtgcccagccattcatttacacaacacgatgcatcattattcaacacctgctgtggcagcttgggaatcaaggctgagagtgaggcatcagcacacacctgggggcagggccgggggtggagggagcctggatcatcgcaccctgacggtgtggccgaggcaagccccttcacctctgtgggactcatctatgaaatgagatcgatgctgtgctgctgtgcatcttgctgagacgtggtgagggtacagcaggaggaaggcgagctggtctgccctgcatctggctcacatcgggtccacagtgtttgtctcctgatgagactgaccttgtggtccgatgactgaggagccctgtttcttagatactggtaggtcctgatgggactggctagtccggggtctgcatacagagctgggaaatgggccaggtcagatcacccagattcttcttcatgcagttgaggacagcggggccaagagaggggagtgaattcattcacaacggcatggtgagtaaggggtagactggggctagacccactttccacactctggaccagtttaggtctcatggttattgtctacttttcaccatttagtaaaatttgcctgctttgagcctgaaatctcattacgggtttcaaactacaatgaaatttttttaactttttcctttctagacacggtctcactctgtcacccaggctggagtgcagtgatgcagtcctagctcacggcagccttggactcctgggctcaagcgatcctcctgcgttggcctcccaaagcactgggattacaggtgtgggccactacgcctggtgatttttattattttgaagacaatttttctaatagtttttagaaagaaaagcattaattttgtttactttttcaaatacatgagttatacttggagtgtttatacatttgcctcttaatttcaatgcaggagtttttaactcatattagtgttgaaaaccatttttgctttaatgacatctgtggtctacactaaaaagaaacgtttggtcaatgtattcatgattctaactcaattttcttaagtaacaacattagataaaatttgaagagggtggcttcatgtatctgtagaaatctctctgatgccgtaagttaccatgtgtggttaaaagggttaatgacaatcagctcagactgtctgcaggtgacagcacagtccaggctggtgtgtgccttgccctcctgtctcccgacaagattggctggggagcctcaagtgaaaccaagaataattccaatcctctcttgcccctgcccacctgtttcaagatgttgccatcttgaaacatctggaaacagaaatgtcttttccacctattgtcagctatgtgtttcttgaaaagtgcacttaacaacgacatttgcagaagagctagagacttgacttagtagccaaagaaaacttggggatacatttgtcctaatgtgacttctgctaatgaaatcatcaagacctcaatttgcagacacccccagaagagctgtttctcccaattatcgcagcgtgataatcagtctgtgttttgaaggctccagaacttttgctaattggaatctggttagatagtctattggcgctcatctgacttatctccttagaagttggccgccaggactacttaaatctggatttgagcggtgggcccgattcctaccggactagttcatctcattgactattcagaggtggcttcttctgcaaggatttggtgtcttttccaaggagcaaccataacttaaatgtgaaaccaactttctgagtgggacacaggggagcctctgtgccctggtctctgcatctcccctctgccccccattccccttgggatccagccacactgacctctgctgttccctgcacacaccacatggtcatgaatgcaagcacatggtgcccactgggaagggaggggctcacgtagtgttggccacagcctccaggtttccctgaatgtctgggtttcaggctggcctcagcattgggaatgcctgcttaccatgatcatgctgctgagggtcttgccgtacatcttcttgaagtgacatttgataagatttaagtcaatctcgctccttgaaacgatgtttcttatcagggtcccatcacgcgtccctgctccctgggcaagacagcagccatcaacaatcctgcctcacctttcctgtccatctctgagtgatggacggatctgtgtggttgggttctggggcttttagagggagggagatgtgggaaggagcctgtgcttcagccagggaagcattaggagggaagctttggtggcttagggtgtccactcccttaattccttctcacccactgcccagaactcttcctttatgatgccaagtgctccaaactgcagtatgtttggtttgccacatcagattctagacacaaaatactcactgctccaggaacaagacttcctactagagcaatggcagcaatcagctcagccaggaatttcacaggcagggccttcctgctcaccttcatccctgaccagtctcatgtcagctggggccacatggccaagggaatcgcatgccctctctcatttcctgggcagaagtggccagagggcttgggtttcgggtgtggaactaacttcaggggatatcagcaaccatcaatcagagaaaacgggcaatggttttagtttcagggaattattcacctctggagatgcagcgtccctttcccagactcaatttcacctccgagaactaaaacctttctgatccacgacaggtttgggtaagataactcccccgtgtggaggatcgtggtggctttgagctccttggctttgcacttggtgctatgtagggtgagcgtcaggaagaagaagacaggacagttaccttcatggcatagtagagtctctctgcaaagtagctgtggaggttttgggtgcatttcactggcaaacaagaaagctgtgttaatgtctggagctggtaggtggcactgcctacaactttatgtcttgccttaggtcttaagagtcagtgttgtgcaaggcttggcatatttctttgttccgtgcctttcccaatgtgagaggctttgtgtcaggtggcgtgggacagggaaggtagcccggggcactgggcacagctccaaaggcccaagcaggcaggcaaaagggtaagatgtgaaatgcaccagactgtggggctcgtctgaagacaccagctcaagcccatccaagggcagctcagactcaggacaggccctgggctctcaacccagagacacctccaccaaaaatccagcctctcagctccacagaagcaccatgggatggtggctgctggcctcagagtgccctctctctcacacttatcagcaggaaccctgcattttgaattcccatgtgacaagtggagtttggccccacaggactaaggcacctgggggcgtctggtccagagactgggcccatgcttgctcccatgggtactgctcagagacttggcatctgggtggggaaggttggcattttcacttagggctgcagaaggagcatgggctttgagtgaggtaggcatgtgttcacttcctgccttgatggtgcagtatggcttcattactcaacctccctgactcatctgggaagtgagactgatgcgaggcttcaaggtgaagtgaataggaaggcccagcatgacggagcactgcatggcttcactattccctgctggcagacttcattcttggtgggttcaggccagatccaggggtggaagctgagattggagcaggggtgtgattagatgtcctgacatagaccggattgtatcacagcatccaaggccagctggggtgtctcagatggccctgtccacccagagaggctaggaaacagcagggagcctgctggctgctggctttgcacggaggcagcctggtgtggaggtgagagctgcaggccaggagtccggacctgggctctgtgtgtaagtgggagaagagacgtccctctgccctgggcctcagctctttactctgcagtgactcttcccattgtgatctcagccctggaacccatgagagctctggagtgggtcctcctgagtggccctgacttcctgctgtggggaagatccccagtgtttctcagcatcagaccatccgtcactcagtttggactcaagccacacatcactgtttcttcaactggcaatgaaggcaggggccaggcccctggttcatgtccagaaagatgactttgtgctggccagggcttcacaaccacagccagagtgctccctgcatggctgccatgagtacacacagggttggggctggcataatcactggcgtatgcatttgtgtgcgcacacacacacactgtctgtctcacacacacacactcacattccacccacagtcatgcacacacaccctcaggcacacacactctcacgcacacacacactcatgcagacacacccacacagcactgggcaccacgtgggcagcacagagaacaatctttggcagcacacactgggactctagaggtggagcagtccctgggtgagggagacaggcagagtgtgagtcggggggacatcccgtgaaggtgacacagggattctttctcttgtggtcgcatccctaggccctttgttctttggtgctgccccacggtgagccctgtggcctgaaaaacgtgcaagtctgagctcttacccacagtgagcatggcctcctccagtgagccatgggtctcactcttgatgctgtcctcaatgctcttgttggcaattttctcatactcttcaaacactgtggagagggctctgctcaggggatggtcagacctcctcgtgatgcccctcagtgtctcggatcagagatcgcacatcaatttgccgccctgacctcccactggtggctggggaaacagtcctgggctccctggctctctccctaactctagacttgacaaggcagaagcacgagggagaggctcatggccaggacaccccctgtggccccggccccagcccctccctccctggtacctctcagcaggtgagtggcactgcgcgtgcacaggatggtgatgaatttcatctcatcagtcccacgaatcttctcgcctgccgcatacagatcctagcattgggacacccacaataagccagtgagggagaccagggaggtgagggactgagccccagagtcccagagctgtggccatggcctggccctgtccactctgccaggccagcatgctcccctgcttggtcgtctctgacagggagctcccctttctctagcagctctggcttagaatattttctctatcctgggccacaagctgctctaggaactgcctggtccccagacttccctctgccagcaggcagacctacagagacccggacacctgtgtccagcactggggcctagcgcccccgggttcatgggctgttcctgccaggacagagctttagtgctcccccacccccaagtcacactccttcctcccgagtctcccaacaccctcactctcctccccagacaccacaggacaaaggcctatagggagctgagctgggtgggtcccagcccagtgtcagagaaagcccccgtgggcagaggagccggagtccagatggcagggggtggggccacatggccggctgggcgcagcctcacctgtgcgtcttggagggccagtcctgggtccacaaagctgctcacatcatccctgctgccctaggaacagaggaggtggctctgtaaggcaggccagctgaccagagcattaagggcacaggggggatcctgggcttggagggcaggcatggctctgctgctctttggctgtggaaacttcgacaagccagttattctcttcagcccttggtttcctcatttgtacaatgggggtggtaaggactgcctcataaggcttggcggattcagtgagctaaggtaagcaaagtgcctggcatgaggcctgcacgaaggacctgctctcctcccgcttccaggatgctctcacatggctgagtaaggacaggtgtgggggctctgcagttgggaccctctaaccatgctgagacacacccaatgagccctggctgctgggctatcccatgcccctaccctgactcttgtggcgctattcaagggctgctccctggggtggagctgttgggactcccaaaccaaggcactcccaagagcctaggctgtgacacctgcaggaggcacaccaggatcctctccaggtagccacttgtgtctgcttggatgtcctcctccaggctggacccatagtctgcagggaaacaggaccatgaggcacaagcagaggcccacagcctacccggggcctgctttcctccttccagccctgttccccatacttctccttattaaagccttctaggaaagaaagtccttggcacagggcatggatgcaatgcccgggtgtccaagtggctgtcgcctgggtggtgcttcacaactagaagcgacatgcgtacccaaccaagctcaaagcacaagatggaccaggtcagagagccaggctaggggctgccaaccaagctccatttcatctcaaggcttggcaaagccaaagcctccaggaaaactccccactaggtacatgatgtggaggactgactggcctctgctagcctggggtccacaccccctactaccacagtcctcaagggcagagattttagttggtcacaggcctctctcccctgtaagaggagctggtgagcttacagatcaagtctgaatcatgttcagtgtcaccatcaggcacagatcttggcatacggtaggtgctcagcacctgtgggtaaaaaagtccccaaagggtcctttctagtgtggcccaggttaattcttgatccttgttccctgccaggctgccaaagcttgtggccactcctgagcccctccatctgtgccaccccttaccttcctcatacgccttcattatctcccgcagctggttcttggtccgagaggccaggatctcaatgatgacaccctccttggttcctaagccctgtggacagaaacctctgcctgctggagtgctctgccatgaccttctgctctgtccacaccttcttttctcaagatgcctgagcctcaggaaggacctcactgccctgccccacttgaagtgggaggatgtgatgagaaaatcacatgcttcagtgatgaacattgagggcaagtgctgtgacggggaagccctgtctcagctctccctccttagctgggtggtctcagacaggctgctccatgtcctggagcctaagcatcccgatccataaacaggaataagaagcctcccctgcgccaaagatagattagggagcgtgggtgtaaaatgcctggcagtgcccatgcagcaagtgtctttccaaacaaaatgactatagttactgggtccccatccttattaatctgcaaaagcaaagagtagtgagaggtaaagggaaacccaaggggctgtgcctgggactgtagaggtgggtttccaataccactgtacacctgagctcgtgaggttctgagaagtactgattttggcttcatcacggccactcaacgtgtcaatcaggcaccagtgactccaggtgttgggtgcagtctgagcagcaggctgcctgctcactgggcccagttatggcccatatggccattccaaacagtggctcaaggggagctctgggctgtaggttcccggtccccgcattgcccctacccagtcatgtgagcacccctgccactcccctgccctgtctgcctggttaccttcatggcgtcatgcagctccttggcttcgtatctgtatggcgggtacataagggccacaatgagcctctcaaacttgccactgagctcagacttcaaggtctcagtgaggtcctaatgcgggaacagggaaaggtgatatttgtcataagccaggcccacctgagtgcaggcagcggagtggtggctgggtccaggggcttgggctggattctgcgtgggccttgccacgtgctggctgggtttcttgggccagctccttagcttctcttagcatcagtatctttaccggttacacggagagaaacgtgctcctgcttcatcccgttgcttagggggttgtgtgtgactcaattcagcattcagtgcagtgctgggcacatcataagctctcagtaaaatgaaattggtattgctagctagactgcaagctctgagtatggcatcaccataaaatacctgtcacttggcactcaatgaatgaatgcatgcctgaattaaagacttcgtctcacatgtgcctccttctaaggtcacatgttgctacgaggagccaccaggctacatcagctgatctacagagcagcagagagatcaagggctttgtcagacctggattttaatccccaccttgttgattacaggctctgggaccttgggcaacttaaaacctctctgagtgccagtttccccaaatgtttgaatacaaagaatgtatcactgtgaggactaagagagggaaactgtaaaaatgcatactgggttctccaagagaatatttgagctgatcttccttcgttacatctccaaactaatgatatgagtcactagaggcttgaggcaaccatggctgtgcacatatttaatcctgtgtttactgtgtacccccaaatgtcaggctttgtcctaggggtggagtgcaggtgggaggagaaacaaagggcctggcatgcttactccaggctcttagaattcccaggtggcagaagggacgaggtgtgggtgcaagcagctcgactgaggaaagcatgcccacgccccagaacagagcaaagccaggcctgcatgcctggggcatggaaaagagaaggtggtctgggctcagagggcagggcgagatagcctgggggcagggagacagacctccagtggggcctgttgggtgcatgagaaggaatgctgtgagagaggaggcaggaaaggaagcaaggaaggccagcccccggcccgggctctgacacctaaaagtagatctgccagataaaacacagggcagccagttacatttgaatttcaataaagaacaattgttttcatgcaaacaggttccatgtgcccatgctgccagtgggctggctctaggggaaagtcgtccagaatggagctgcctcccaggctgtacccccaaccccaaggctcacctatccccacccccaccagccttccccttgccttgccgaactgagccttgaaggacttggcgatctgctgccgctgcgtgttgcttctcttggtgagcacatcgatgatagcctgctcgttggtccctgcagggttacagcacaagtgaccctgctgcccccagggtgacacactggtgagggcggaggaggggaaggcgaaggcagctgcttggtggctgagcagttgggacccgacacctggatagttccaaacccccagaccattttcgtggtgtaaacaagacccttaggaaatctgcctccccatttcccaccccacacccccacaatgttggggcgtgcccaaggccagcctcacaagatggaatctgaggtctgggtggctctggacatcagcccgggcctttggagcttggccgagtgagatctctggccctgccctcctttgtgttggtcgcagtaggggaaggtcaagactaagagtccaacccctgaatccgaggcctggcccagcaactgcgtggcattgggcagccagcctcatttccctgggcctccgttttctcatttgggaagtggagataactttctgcttcacagaaagcagagggcatgagaacgttttctgggcttgtcaggagcggcagttctcattaaggcccctgatcctcaggcagagccggctaaggggtcagtcccacctggggtgaggtcagggtacatgctctgctctcaggtcaggagggctttctgggcaagctgtttaaatctggcctcaggccagccctcgcccactcacggtagtgctgagggcagcactgggcaagtgcaggagatgggaagggagccggctccatggccatcgacatggggcaagggggccttgaatcagccccacaaactcccaacacctcacacccctggcagctctgtgcctggcatcataaagcaccacccccttcacacttcatgtgacacacaaggccaagaattcttggggccactttacaagtgagaaagctgagactgatgggaagtcactcacagagacacacagctcacctccccacccccattacccagggaagagcagcaccctcctgtccagtcttgcagggtgggtgctgacctcactgcagaaacagagggctgtgtgattctctgggtagtggaatcagtttcagagtatcatgggacaccccagctccccagatgtcccctggcacccgctttccagggctgtgagcggaggggtcttgagcagaggtggcaaggctgccaacacccactcaccgatccccttcatggcttggtagagggtctctgcatcagggtctgggttgaagtgggagctgctcttcactgtgacaccctcctgttcaatctgcaagagaaccaggcctgctcaaagcaggcagggacagggagggcagagcaggctcccagcccatctggtagcccgccctgacagggtgagccccttccctgggcacggagatctgctcagcccttgcaggccagtgctctgcccttcagccccttggccaacagggtggagtagccagagccagagcttgtggggagaagccacaaaacctttcctgtccctgtctgtgccatctgactgcagacagcagccccagccacacccagctccttccagcatcacccaccagcagcaggaagggacaaactcacccaaagttaggaggggaaagaacactgaagcaaaggcttcctggagctgcatgcaccaccttcagagtgtgcagatgaggttggaaggctgagcatggttctgcctttctgaggaatggtttgagctcagtctgccctcttcctggggagttgggacttacagcaacttagagggcaggggcccagctgagcatattgatagttcagggtgtttgcaagtccacaggcccatggggctcagagcgtcaggtttagaaaaacccgcacgatgctctgcagattgtgaaataaaccagataaccaagtgcctgagcccttgatttccaagcctccagttcagggcttgcctgaaggctctttaaacttgtgccctgcagaatttctcagatgattaacatggacataagtgtgttttgggtggaggaatggtagagaatggagggatattggagataggtattgaattagagggagactcagagatcctccaggatgaaaaagagtttagtcccatccagtcttgtcttccatttacctgttcacttattccttccatcacctccatcatctgcccatctactttcccacctacgcacttacccatttgactaccacatccatccatccatccacccacccatccatctatgcacccgcccatccatccatccatccatccatccatccatccatccatccatcgaagccctgggttagattgtgaaaatacagagattccaatggatggtatatctgtaagtatctttcctttgagtaagaggtaaggcatctttctgaactctttgctttaatttcaaatgtctggtgacagatcttcctgagtcatttcttagcaccatgtttcacagcagaaattgttagaaataattcctatggaaattccatccagagagagccagtgtggtcccagatattgctcatcggtgtccacacacacgatatcccttgcttgtggagtcacgctctgctattactcctgttagcacttcaagccccttgtgtgtgccagacctgggccaggtgctttagaagcaatgcttatgtcatggcttcctcaacagttgtgctaggtaagtactgatgcctcactttacagaaagggagctggactcccttacacagctagtaagtgatgctgttgggactccccagcctgactcagaagctgagctctatctacctcccctgccctactgatgactccacctttcccagacaatgagtgttcctggaacgttccactgaaggaagcttcacccacaggaacgcaggtcatctgggaatgtgggaggcatctcagctctcagtgcctgccggcttccctctgccccagcactcgggggctgtggtgcaccagcgagtggccaggctgtgtaaccgcatccctgaggagcatgcagtcccgcaggggtgcggtaggtctcaggtgcagcatttgtaagcagctccctggctggttctgattttgctgcattgagaagcctctgtctcacttcccactctaaggttttagaaaataagtgttctgggaatcggagccctggctatcagtgtggagtcctggagctccagacctcctgctgagaaggaagggtcagcctcaggctcctgcagggtcttgcccagggccgtgctagtccagacaggcacattttcactgaaaaggtgactcagaccagcctgtgactacatctattaatataacttgttctgtgacaggcacaggggagctgccacgccttggccttcccctgctacgtggctgcccagaggcctgggagatgggtttgtctctatgagagacacagaggaaaaggcaacaccaaaaagagaggtgcagatggaccctgcctgcagacagatctctctccagtggctccctcatctcctcccatcgcgttcctggcccagctttgtgcctagaggacactgggtcttcgctagcagctcagctgttgcaggtggggtctacctgtgaacttgctacccctagccagctctcacatggggtatggacgaccagggtatggttttggccctggagtcaggctgttcagattctcacctagactctcacacttactagtgagttcgggcacctgcctagcctacttgtgcctcagtttcctcatctgtggataaggatactggtgtctacttcatagactccttgtgaggttcaagggagatattgaatgtgaggtgcttagagaagggtccggccacagagtagggactcagtgagtgtcacagtgatcctgtcaatttggcaggtccctacatggacagccctttgtcctgctgcactgggtgcaaggcccagtgccagactgccttggccagcaactgactttggaaaccacccagcactgggctctccctgccatgtccacctcctcaaaggcaggttcccagcagtctggttgaagctgcaggcctccatggccccttgtcctggaagaaggctgcttccctgggggccaggacagctgccccacctcagcctggcttcctctttgtcccacctgtccagaacctagcatgtctgaccctgaggacacttgcttgggttgcgacatctatgatccagagactccctgaagctggacaagcctgggtatcccacaaaagctcacagagaacctggggctgggcagagagacccaactgctctctgactggagcctgctggccattggaccctagcaagtcactcagtgtctctgagccttcatttcatcatctgcaaaacagaaagtgcagccctgacatcctgaggctgcctgggaggaaaggaaaagggtgtgcagagccggcagccgggagatgtcacctctgtccccttctggatattcaactccttagcacagcgatggcctcaggctcaaccatagatggaaagctcccgagaacccatcagttctgctggggatgggctgccctgagccccgggttcctccaggctctagcaggccaggtcctcctgcttcccctcttccctctccagtcttgacaaatgaacatcattgatccctgaggtgaaggcattgatgggtccccaacagcaggttcaggttactctcatgctcaaagcccttcagtgccttcccacttctcttaaggtaaagcctaactcctcagcctgccaggcaaggcctttcaggacctggccctgcctgcttccccaggtccatctcctccggtaccaggacccttgagctgtgctgagcagcttccctcgaagccaagctccctgccctctgaccctctgcacacagttccctctgccaggagcagtatgcctgattctccccaaatgcacacgtgtgtgcaccccatacacatttacacacaaggctcaaccatgataccccctcctttgagtggccccacccctgcaagggtccctcccctggactcttctcaaacctcagcttcccccttgcatttctagatttcttcatcagcctgtctcccggcccaggtcccatccctgccgtgggcactctaggcctgggactgtttcttctcggccccttcccaccctccatgcttggcccaggaggcagccaaatgtagactgagccactcccagccaagggcgactttacatttctcaggactccctggtgaccagcacccaacaccatgcaggaacccaaatctcctgccagctcccacttacccaggatttccaccaggccatctctttcacctcgggggcacctttcccagggagatgaagagacacaggttggcctctgctgggactccacacgtctggctcctgcagctgaggagtgagcaggccgctcacttgggtgtgggggtgcaagcccgcccagggcagcgccacacctgcctgccgtcccctcgcccccgggctctgcctggctttgggcatctcctgtggctcccaggccccacccagacactgcccaggcctgctctggggaattacacaactcactggcagatatttgggctgtggctgttacgcatactggaaattcttagctccagcctgcgaaagccccactcagtaaacacagctccatgttgattaggctggtctcaaactcccgacctcaggtgatctgcccaccttggcctaccaaagtgctgggattacaggcatgagccaccgcacccagcccattttcatcactcctaatagccatggagtatgccatttaatcaactgcatatgcaatattattttttttttccgggggcaaggggctcatattcaccacagatgggaggccagttggtgagaaggtggcaggcggcacagccaccttatacagcatgccatactggtccactgtcagaccggtgatggcctcagctccatcaccccccaggctgactctggctcctgcctggctctgcccggccaccacaacccctcgggaccattcagaggcatcactggaggatgtgtggttagtggagcagctggtcatggggaggtctcgtttctttggtggaaggcattcctggttcctctcatgaacaggtttcatattgctttgtggtgttcctggagcctggaaggagttggcttgctccctggggcatcaggaggggcttctctgtagcttctctgaacccctctctgcttctggctggggcacctacatctgagcttccagtggtgcttctgagcagctgtagtaagcgtcctcccggctggctcgggagccagcccatttcaccacgcttcccgggatccacccgctcatcctggagccgctgcaaacctggccgccgccatccccagccccggagctgccccatacccctgtatatgcaatatttgttaaccattcccttttggtgcccatctaggtacaggtatcatttttggagctaaagtatctataatacactggaagtaacagatgtcacctccatattgtacgccaaacctaataagcagagcaaaacttttcatccaagcgatttggttaacattttaggatgtttctaatctctcagtaatacaaatatgctacaatagatctgtgtgtttatcctttgggcacctgtgtgtgcctgtgcatacctggagaataaagtcctgtgagaggaactgccatccaaagagggtgtttcagtctgtactgccaccaacaatgtgcttgtgcttctgagcttgcgtttgggtcaggagaatttgaaagtcatcaggaaccaaaccaggatataaggttcagctgtagctggaaagtggcaagcgttccaaagctaagacattggctatacctgggctgttcacaaactgtgagtccaattctagatgagatccagaagtatggtgagcaactcacttattttttaagcaaaacaccttttcttctcatttctgctaagaacaaatagcttccagcaagagaaataggggatgcaatatttttacaaattacttctcttttttttaattaaaaaatgttaagttaaatgctacttaaagatatgtttaacctctatgatactgacttgctcatgagaaggagagagggccaggcatcttgcccactactacccactatcaacacttaggcctgacatcagtctctaaataaatattctgggccaggtgcggtggctcacgcctgtaatcccagcactttgggaggccaagacaggtggatcatgaggtcaggagatcgagaccatcctggctaacatggtgaaaccccgtctctactaaaaatacaaaaaattagccaggagtggtggcgggcacctgtagtcccagctactggggaggctgaggcaggagaattgtttgaacccaggaggcagaggttacagtgagccaagaacatgccactgcactcctgcctgggcaacagagtgaaactccgtctttaaaaaaaaaaaaaatcaacagcagcttctaggatgatgagcagtgactcagtctctccttgaccagattctgtaaccgtccagcagaaatgcttatctgatctctgcgagaacaggaagcagctcagtgggggccttccttgctaaattcttcatcaagctggtctgttatctgccctgagtcctgcaagaacatctcaagaaaaatcccaaaaacatgcaagacaaatgagggtcctcccttagcatgtcttgaagcactgaggcacctgaaagttgtatatagtttctggtgaaacagttttttaggaaatgaagcacagacactaactattcttccagaagagccccttcctgacatgaaagatcttacttagcatgacagagaagcatctgtttcatcatgaggacctatccaaccagcagcaggggccccagtgccagtgtccacctcagcagaggagacacgggggacatgcaaagtgtttctgttgaaaaatacttcacctagggtgactatagttagcagcaatgtattgtatatttcaaagtagctagaaggctaggtacagtatcccatgcctataatcccagcattttgggaggcccaggcaggcagatcacctgaggtcaggagtttgagaccagcctggctaacatggtgaaaccccatctctactaaaaataaaaacaataaaaaataataataataaaaattagccagagatggtggcctgcgcttgtagtccaagctacttgggaggctgaggcaggagaattgcttgaacctgggaggcagaggttgcagtgagccgagatcacaccattgccctccagcctgggcgacagagcaagactctatctcaaaacaaaaacaaaaacaaaaacaaaaaaacaaagtagctagaagaagggacttgaaatgtacccaacacatagtaataccaaatattcaaggtgatagacaccccaaacaccctgattgatcactattctgtgcatgtaataaatacttaagtgtacaccataaatatgtaaaatatgttatgtcaacaagaaaatactttgcctagtgtttccatccaaatgggaataaatccagcgctcaatgtacacatgtcatggctttttattgagactggggaagggccgtggtagcaggtgcactcactgtccaagtttgtccagactttctgctgcatgggtgatggcatttgtgactgtgttggtcactgtctcggtgatttccttcatctttttgtcccctgactcctgggctttctttatggcttcagcaatggctgttggaaagaggaagaatgtcctagtgatccacctgctgaacttgtgtccccttgagtggcctgtgggatgtggccatcttaatggattagtctctggagtggcccgatgggaccaagggcagcaggattactgcagaatgaatttgaatttggttttaatttccccaacaacttgcatttcttcaactgtgagtgagactgagcatctactcatgggtacattgcctgcttatccttttttctggaaaatgcctgcttatgtcttttgaccatttttatattgggttgttatattggattatcatttttatgacaaatatttttcatcagtgtataatttttcttttggcttggtttatagtgtttttttttttggctatagaaaatttcagttttggattgtcaaatttacttaatatttcctttatggcgctgatttttttgtcatagttctaaagattctcccctctccaagattaggccaaagtctctgatgttattactatgtctaaatgtttacgatgtcttccccctcaaaactcatatgctgaaatcctcagtcttaatgtaatgatattaaggggtggggcctttgggaggttgaaattagcacccacataaaagagaccacggagagctagctccttccaccatgtgaggacagagctgggcccatccatgaaccagaaagactccctcaccagatgccaaatgtgccagtgccttccttgatcttggacttcccatcctccaggagtgtgagaaataaatttctgttgtttctaagtcacccagtttatggtttgtttttgtttttgagacagagtcttgctctgtcacccaggctggagtgcagtggtgcaatctcagctcactgcaacctccgcctcccaggttcaagggagtctcctgcctcagactcctgagtagctgggattacaggcatgtgccaccatgcccagctggtctttgtatttttagtagcaatggggttttaccatattggtcaggctggtctcgaactcctgacctcaggtggcccacccgccttggcttcccgaagggctaggattacaggcgtgagccactgcacctggcctatggtattttataagagcagcctgagctaagatgtttatctcctagtaagttaataaattcatttatgtaaatgtaagtccttcatctacctggaatctattttgttgaaaaggaatgagatatacacatgctttgtacatagtactactcatagctcacacacatcaatttaacatttaacatagaattttacatgttaaatttttttttttttttttttttttttttttttttttgagacagagtatcacactgtcgcccaggctggagtgcagtgtcgcgatctcggctcactgcaagctccaccttccaggttcacgccattctcctgcctcagcctcccgagtagctaggactacaggtgcccgccaccgtgcccagctaattttttgtatttttagtagagatgcggtttcaccgtggtctggatctcctgacctcatgatccgcccacctcagcctcccaaagtgctgggattacaggcgtgagccaccgcccccagcaattatttttttctttttttttgagaccgagtcttgctctgtagcccaggctggagtgcagtggcatgatctaggctcactgcaagctctgcctcccaggtacacaccattctcctgcctcagcctcccaagtagctgggactataggcacccaccaccatgcccggctaatttttatgtatttttagtagagacggggtttcaccgtgttagccaggatggtctcgatctcctgacctcatgatccgccctcctcagcctcccaaagtgctgggattacaggcatgagccaccgcaccctgccatgttaaatgttttgtcccagtgtgctgtcacatagtcttgtgtgactttgtcttcttattccacagagagaaccatctagacagtgtcctaacgcagtacagtctgtggcctctgatgagcatagataactgccccagccaagaggctctgaaaggctgcaacattaggggcagagtttgacctggttagtcaaagaacaggttggcccagcacctagcttcccttcctccctccctccttccctgcccgacctcagccggctgtacctttctctccagtctccttggcatgtcccaccacctccttcaccacttcctccacggcatgaactgaacagaggagacaagtccagggtgagggctcagagcaggccggctgcccccgagtccagggtgagggttcagagcagagccgctgccctcccagtccagggtgagggctcagagcaggcccactgccctcccagtccagggtgagggctcagggctggcttatcctcacaacagacctatacatccctgggcatcctagatggggctctggggtgccacccccagccaggacagactgactcatgagaaggaccttcccccacagctggcttcatttggagacgccagggccttggctgctgggagacgagctcaatgagccccatgagggcatgggtccctgaagccccttggccctgcccggcctggaatggcaatgagcaggcagtcttgccagctgagacatgaagcccaggctgggcctgtgtgccaggtcacacccctctcaggatgtgctagcgcctgcctcaggttggtttccaaagcctcatccactaagaccaggtctctcaaagcaattcctccaacaaaacggaattctctgcctacttcagagttttttaaagtgtgggtggtagcgtgctagaactgaaggatttcagagtcagaagaaatggttcttattctaactctaccttccacctcttggttccctcatctttagaatgggaatctgttgggatgatgagacccaacaccaggtcacgggggcggcaagtccagcggagtcaaaggaatgacaaagagacagttcgagagagaaaatgggagcagggcgctatcgcgagtgtggaggctgcgaaggccccgagttctgggagcccacgctatttattggtgatctaacaaagaaacaggtggtgaggatgtggaggttgaaaggaaacagtgtatcaagtgaatgagaaacatatggctacttgagagaatggcagtgctagaagcaaggagccagcaagtctagcaagccctgcctcagcttttctcccaacgctgagcttttctcccaacaggaatcataaaaaactcagaggctagtgaaaggttaaagcaggtggtccacaccagctgcagagtcaaaaacaaaatacgcatctgctgccatttagaaagaggacacaaactcaggcaagactttttcacacgatgacccatgagtggggcctggctgggcctccccacacatacctgctgacctctgaatacaacatacacttcgggaccaggtgcagtggttcacgcctgtaatcccagcactttgggaggccaagaggaatggatcacttgaggtcaggagtttgagaccagcctggccaaaatggcgaaaccccgtctctgctaaaaatacaaaaattagtcgggcgtggtggtgggtgcctgtaatcccagctactcaggaggctgaggcatgagaatcactttgaacccaggaggcaaaggttacagtgagccgagatcgcaccactacactccagcctgggtgccagagcaagactccatttcaaatacaaatacaaataaaaataaacatgctttaggggacttggatgaaattgaaaatgcccttttagactttgaacagacttggtgacttgttaagaaatctttgaagctttaaagttatggtaaaaataaaaatccatcttccttttcctgcataggttattcagaataggctgttttgacaagaaaggctccccagatttccagagggaagggtccaagctgccagtgttcacccagcaccaggactcatgccctgcccccaggagacctccccaggtctgcacccctcaactccgtgctgacttggtagagcaggagaccagggttcctgaggggccaaggcctccccgcaggtcctcgcctgcctacgtagatccgcctcccacagacccagtctgccccagatccccccagcccaggtagaaaggagccctgggtcctcactggctccctcggtggccttctcggtgcggtgggccaggccctcggcagccagcttccccaggcctcccagcatcgtgtggcagcagacagtggcgaactaggatgctgaggactggcccaacatgcttttatagctgcctctggtgcctatctaggctctggggcaataagccctcaccccagcccagtaggaggctggacaggtgagtcagtgagggcggcagcaggaaggggctgggcggagccaccctggaactagggtggcagcatcccctgacagcatgaggcttctgtaaccctgtcctagggaccccgtgaaggataggggcatggagcagggctggacagtagagatctggacatgcttcttccttgaggcagagggcctgagtgccagcccccctgagaccaaagcttcccaagcctgggtactgatatgtacctggagacaaggcctaggattccaagcctgctgctcaaggtccccagtgtggcctagtaagaggtttgggggttctatgggcctggagacctgggcagtcctttgagtcatgaacacaagtggaatgagggtgactgccctccccattcctggagaccctggctctgcagagcagtttgcggcctccatgggacagggtggggcgttcagggtggtgccttgcccgagtcagaggggggcacagcactgggcagaagcgtagtcacctggtgtcgctcagctgatgctcactcacccaagaggctctgtgaggtcagcagtgccctcctatcccctggcagtcctggaggagtagacagaggcctccaccaccactcagggagatgcttctggccttagctagaatcccctaggaagcagcttccctggctcctggtgcatcgcatgaggagtggcagggctgctccctagttactcatgatggacagacatgcctcaagccacctgccacatgctgcttcccttagtcaccagcccaacctgagcctccgtttcctcatctgtaaaatgggcatagcgtgccttcttggctgtgtccctaatcatccctgaggcaaagcatgcaagctcctggtaaacacctgttccctccactcatcattgaggtgccctttggcagtgagctctgaccaactggtagggtgtgccaaggagtgactgggacgtgaggctgccttggagccagagggctggggaatgtgacttctgctggccaggagccaaggagaggtcttcccatgctcctacttctggggtgcaggcctgtggcaggggtctgaggctctctccccaatgcaggctcctggagctgctctcctggatgtgtcggggcctgattagtttactggactgtgggccctcccagcctgggactcgggagctgagaccctcttgcattcctgcatggtgtttgcgggctccagggctacggccagtccccctagggtggacagtgggtatcgtgggcagcaggacctctgggtctcaagactgtggccccacacatgccattgctgtctcctttgggcaggggtgaatcggggcttcaacaatttagaggggcctctttatgaaaaagaatacaataatatgattcttgcacatttttcatttatatacgtatgaacttctggacccagaaggggctgtgaaagtcgggggcctggagctcaggcgggtccagatgaccctgtcctccttttgtaacagccagagtccaggatgctttgcccagggcattgggctggcactgcagaggcctgggggatggggtgacacctgggacatggctggtgggaattgttctaggaaacctcagggattctccctggacctgtcaaagccccttccctgtttcttctgaggctgtgtgtccccccactcacacaagggtcctttctatgcctgctcccctgataaatgtcatctgcctgctctagaatggcttccagaccccacagaccccctcctcatgagctcccaccctagggtactctccaccagtccccgctttcaggagctcaccagacccagacagcctgttgtcagagctcatccacacagcaggaccctggcccactgcccagcccagagccaggcccaccatggcctctggggacaactgcccttccccccaccccctccacatggtcccctgcccatgagaccctgccctgctaatttaatgcactgccttggtgtgagcactgtgattctaatgacaacacaccatggccttctgggcgaggctgggtccagacacagatcccaaatgcctgctggggagaaggcaagaggcccggggaggcccaggacaagacatgggtcccaggccctggtgccctccctcttggccttccagctgctgctgctgtgaccagattcccattcacccagccccgtccatgggccccagcaagccatctgtgccccacagagggcagacccctaagagtgggacccctttctagccaaagaacatgagatagccccaaatcctcctaaacatgatggatcctggtctgaggggctgggctcaggtgactcctgcagggaacttcacctgcctggatgaggtcaagtgtgaatcaggtggggcctgccctccaccaccccatcatggaagaggtccagcccacagtgggcccaagagggccgcccttggacctagggacccaagtcagcatatcctgagtcagaaggtcaagtccagcctcccctcaggcagggagaatctggctttgacaggagcagataaattctcaaggtggaatttgcccaacatactagtttggcaagggactagctggctgaatcactgagtcaaggacagccaacgtttccaatagcaatttgccaacttagcaattaccaattctgaaaaacaatttgtttatttgaaacacttaaatacttaggctgtctcatgtctgaagcatgatgatgccttgcgtgatttaaaggacagacgtcacgaatgccaagagttttgtggcggtccatcctgccagtgtcttctcccacttttgttctgtggatttgagctcacagtttgtgctgtgcccaccgcctgcccaccctaacgagactcctggagacttggctggccagtcaccagaggaagaggggcccagcagcacgccagcattcacccacctgtgggtatcagtcaggctcctggtggaagccagaggacatattcgaatgggtacttgaggaaaggggctgttcacagaagtgtggaccgagttaagggaaccaataagagatgaggaatgtcctggaccagcaagagtgggagctgttatctccctgggtctagagggacaggaaaggtgtccacagatcccaaagagagctgtggctgtagaggaggatcatcaggagctgcagccatcagtagaaagatgtggccactgccaaaccaacaaggaagaatctgagcgaataaccacctctcctctctctctctctcccacctcctatgacgtcctccactgtgtgaattccactagggccagacagtgaggcaccctggtgatgcagtccaagagggagtgggcagagaggagccagtgggtatggaggggaaacagagaaacagagaattccagctcactctgcgggatttctgggtctgatagaaacatggcattattattattattattattattattattattattattattattattttgagatggagttttgctcttgttacccaggctgaagtgcagtagcatgatctcggctcactgcaacttctgcctcccgcgttcaagagatcctcctgcctcagcctcccgagtagctgggattaccggcacatgccaccatgccttgctaatttttgtatttttggtacagatgaggtttcaccatgttgaacaggctggtcttgaactcctgacctcaggtgatccacctgcctcggcctcccaaagggctgggattacaggcatgagccactgcccagcctgcagcagcttaattttacagtgtcccttttctccttctggaaactatatggggcaacaacaagactgaggaggaagaggaggaggaggaggaggaggaggaggaggaaaaagcccatcatcaatacacacatcaaactcaacttcagagaaattaggaagctgggaagccacgtaaacccaaaagcaggagacaccagcagaaccaacgcaggaagccagggaagtgcagaagaacagggcatggggggcaacccaggggggaatcttcactgttgccagcaacacacattcccagcaggagaggaccctcagagtgagaacgcagagctggagaaatgaagaaggagcaggtggtgcccggggaagtccaggggtgtgggatctgagagcacgccttcccaagagaggcgggaacacttgggaaggcagggctgagtccctggaggctgtatctgggaaaggaggctggcagtagaatcttcctgaagccgagtaggttctgagaggcagaggggcagtggtacagaggtgaggctgacgcttctgtgcaggaagggcaggctcctgaggaagggagccccgaatgctctccactagattcccagggagccccactccctccacagggacctcgcgctgacatctgggaaatgccattcatactggaacgtccgacacactgccatgaatgtgagggttttgtgactgatggggtaggtttctctcttccaacttaatagtataatgtccatttattcctcccccagcctccctgaacatgcacctcttagatagccacagtacggtgatcagaaccaggaaatccacattctcatatttaactatattaaaattatttcacaaaataaccaattttattaatttaattaaatacatttaactaatgtttaaatatatttaaataatttaactgatttaaaatgaacatattcgctaaacaaaagaccttattggagtttcaccactttttccactaatgtcctttttctgttcccaaattccacccaggatcacgctgcatttagttatttcttagtctctcgccgttttgtaggactgcaataacagttcctcaatctttccttatctttcataaccgtgacatcttgaaccagtactgatcagtatttatgaaatgttcctcgatttgggattgtctgatgtatttccatgattggactgaagttacgaacttttggcaattacagcacaaaaatgatgtggaatccttcccagtgcattccatcagagttatggcattgatagttcttcttactgatgatgttgaacttgttcatttggttcaggtttctgctgggtttctccattgtaaagatactatctttccccctcatagggggaaagatcttaggagaaatacttggagactatgaaaattttgtattttctcaaacgttaaaattttttttcaggccaggcgcagtggctcatgcctctaatcctagcactttgggatgccgatgtgggtggatcacctgaggtcaggagttcaaaaccagcttgatcaacatggagaaaccccatacctaccaaaaatacaaaattagccaggcatggtggtgcatgcctgtaatcccagctactcaggaggctgaggaaagagaattgcttgaacccgggaggagaggctgcagtgagctgagatcgtgccattgcactccagcctggataacaagagcaaaagtccatcacaaaaaaaaaaaaaaggccaggcgcaatggctcacacctgtaatcccagcactttgggaggccaaggtgggtggatcacctgaggtcaggagttggagaccagcctgaccaacatggagaaaccccatctctactaaaataaaatacaaaattaactgggcatggtggtgcatgcctgtaatcccagctactcaggaggctgaggcagtagaattgcttgaacacgggaggtggaggttgccgtgagccgagatcctgccattgcactccagcctggccaacaaaagcaaacctccatctcaaaaaaaaaaaacaacaacaaaacacctattttgacagccgggcatggtggctcacacctgtaatcccagaactttgggaggccaaggcaggcggatcacctgaagtcaggagttcaagaccagcctggcgaacatggtgaaaccccgtctctactaaacatacaaaaattagttgggcatggtggcatgtgcctgtaagttccagctacttgggaggctgaggcaggagaatcacttgaacccagaaggcagaggttgcagtgagccgagacggcgccattgcactccagcctgggcaatagagtgagggatctcaaaaaattataatgaaaaaataataattctattttgaattgtggtaaaatatacataaaatttactaccttaaccacttctaagtggcagttggaacaggggtcaaggagagcccttgggttgggtaatgtatattcacattgccatgcaaccaatctctggaactttttcatctgacaaaaccaaaactctatatccactaagcaacttcccattttctcccttccccatgtccctggcaacccccgttctaccttctgtttctattagtttgcttactcagtctggacgcttcacataagtgaaggaacaccgtatttgtctttttctaactggcttatttcacttagcgtaatgtcctcaatgttcatccatgttgtagcatgtgttagaatttccttcctttttaaggctgaagaacattttattgtatgtatataccacattttatcaattcatctgcctatggacaactaggctgcatccatcttttgacgagtgtgaataccactgctataaatatcagtgtacacatatttctatgagaccttgctttcaattattttggctatatacccagaagtgatattgccggatcatttggtaattctatttttaattttttgagaaactgcctgtcctgtgctgagcaggtctatataaacctacccgcaaaggccaaggaacctgagataccaaagaaagaggctgacaaatccagtttctcagaaagaaacatttaataggcgtttatgaacagaaggcaagtcagggatggcaccaagataagatggtggatccctgtgccatcacccccacccccccgacccagggcttctatagcataggggaagggtaatgcgggcttcagcagggatgtgtatggccagacacggtggctcacgcctgcaatcccagctctttgggaggccaaggtgggcggatcacctgaggtcaggagttccagaccagcctggccaacacggtaaaacctcgtctctactaaaaatacaaaaattagccaggcgtggtggcaggcgcctgtaatcccagttactcgggaagctgaggcaggagaatcgcttgagcccaggaggtgaagtttgcagtgagctgagattgtgccactgaagtccaacctgggagacagagtgagactcggtctcaaaaaataaaaaataaaaaataatttttttaaaaagataaaatagaaatcgtagatgaattgttggaactgggattaatcagaatatggcagattagcatccaagatggaattgctttattctcattcaaggtttccctcattcttcactctccccatgctggtcaccttgctgtttgttcctcaaacacatatgaaatgcgtttctgtcttggcagtcatcctgctacctgtaatgtcagcactgctttctgttgtcccttcagtcaggtcactgttcaaatagctctctagacaggctcttccttatcattctacttaaaatagcccccaatcactctgtgtccctttagcctgcttcctcttcctgctatttcatactacctgaaaaaatacttgaacttcctagaacataagctcataaaagcaagaactgtgctccacctctcctctcctctaccccagcactcagaagagaaacagagtcagcatccagtgagtgttcatgaatcaagtcactgcttggcagaattcagcactgggaccacagcctcgcctatcttcaactctttctccttctgcttttcctcctcccactctagtagccactcttctgggggcttgtcccttaaatgattagtccttactgacctattttctgtccactttatctgtttttgagagagggtctcactctgttgcccaggctggagtgcagtggcatgaatatgggtcactgcagcctccacctcctgggctcaagtgatcttcctgcctcagcctgccatgccatgtaactgaggccacaggcatgtgccaccatgtccagctaatttcttgatttttttttggtagaaatgggtctcactttattgcccagtctggtcttgaagtcctacactcgagcagtcctctcaacttggcctcccaaagtgctgggattacaggcatgagatactgcacctggtcttattttttcttttcttaagatacagggtctcaccatctggcccaggctgaactcaaactgctgagctcaagtaattcccccacctcagcctccgaagtagctaggactaaaggcatgaaaccaccatgcttggcttgtccaatttcattctacacactttcttggtatttaaacagctgctgttgctcttcattctgtagctctacatcagattcatgctctagtcctgtatatccaaatgatgactagaggctgccggctctgctctttcaaaggcacaatgagcgtagcccgtctacaaaactctcccttttccaatccagctttccctcctgcatcacctatctctctacatctggaaccatcggcagctgccttcataaggcacctcagtctggcattcggaaaaccaccctgtcttgccagagcctcttggtcttgggtagcaaaagctgtatgcaatctaaatcaagctttcaatcatgagaaatcacattccttcttttccctttgtaatatactcatgtgtttttttttttcctttctcaataagcaaattgtaccaccatcttattctgagatgctcctttttaaaagctgtagatcacattaatggaagtggttactgctgggaatattttccatgtgcaatgatctgtaaccctctttttcttttttttgagaccgagtcttgctctgttgcccaggccagagtgcagtggcacaatctctgctcactgcaagctttgcctcctgagttcatgccattatcctgcctcagcctcccaagtagctgggactacaggtgcccgccaccacgcccagctaatttttttttttgagatggagtctcgcttggtcgcccaggctggagtgcagtggtgcaatctcagctcattgcaagctccgcctcctgggttcacgccattctcctgcctcagcctcccgagtagctgggactacaggtgcccgccaccacacctggctaatttttttttttttttgtatttttagcagagatggggtttcaccatgttagccaggatggtcttgatctcctgacctcatgatccgcctgcctcggcctcccaaagtgctgggattacaggtgtgagccaccacgcctggccattcccagctaattttttgtattttttagtagagatggggtttcatgatgttagccaggatggtctcaatctcctgacctggtgatcagtccgcctaggcctcccaaagtgctaggattacaggtgtgagccactgcgcccagcctaactgtaaccctcttatctcaactagctgacattattacttcacatccagttcaatttataaattaagagaggtgccatgggcctggtacggtggctcacccccataatcccaacactttgggaggccgaggcaggtggatcacgaggtcaggagttcgagaccatcctggctaacatggtgaaaccacgtctctactaaaaatacaaaaaattagccaggtgtggtggcaggcacctgtagtcccagctacctgagaggctgaggcaggagaatggtgtgaatccaggaggcagagcttgcagtgagcagatatcatgccactgcactccagctggggcaacagagcaaaacatcgtccaaaaaaataaaaataaaaataaaaatgaaaaagaggtgccatgtgtacaaaaatcaatgcacatttatgaaattttttttcaaatatattttcacacattttatctaaatacataatacagaagcctgtgtgacttgggcaatgtggccaggagggcctgagactaacacatccaccttggcaaaaggacataaaatatgtcttatggtcagaaaaatcaacattttgtgtatttacttagtttacgaaaagtactgaaaatgctattactagctgaatttgtgatttccttttgaaattctgagttatccttatttttcccattttgtttttgcaccaaggagactgcagtcaaataaaacagatactacacgcactcgtcggggcagccgtactgcagaagcacgttgatgcactcctggctggaggcctgccgggcgtaggtcagcgctgtgttcccgtgggcatctcgggccatgacgtccaccccgtcaggagctgctccaggaccacattccccttgcggcaggccagatggagtgccgtgcagccgtctccctccccacaggtctcgttcacctcctcacgggagccatgtgccagcagcaggatggctgtctgcaggtcctcatcagtggtggcccgcagcagctgctggcccagggacagctcagtgcagggtagtggggccagaaagagcttctcctcatatttggaacggatccaccattccttctcttccctcgtggactttattgagggttttgtctgcccctggctgctcccttcccagatgctgttggctagctcattgccaatagatgacataaccttcctgagctcaactggccagtcatccagctccagagatcgcacacgggaaaggcgggtgccaaaactgcggtggatacctgagcattcaatacacatgaggactcccaagttcaaactggcccacttaggattctgggtctcacagtccacacagtgggcgttcccacgcatgttttggatcgactgcagggccatggcctcactctggctggtcagctgggacttgcttttactgctcttgcatgactgcaggctggccaggatctggctctggatggcttggacccaggcatcccgctcctcatacgtcgtggcttcaaagtgccacgtttggccagtggcagacacaatcataaagttgttggtgcttttcttctttaggtgtttctttttattggcatgaggagaggggggcgggttgagcttggggctggtggtgctggagataccggggctgaagcatatggagtcacccagcccggtgtccatgtccttggataggccattgcttttagagctggagatgggtgcacaggctgatgtggctagggatggccactttcctgggactttgatggtagatgtccgaaggtcaatctcttttttatgaatattcttcatataatcacctaagcttgaataataggtgagcacgccattggaacacagggtgacgtatttctttttccatgtcttcagccattttccacttcgctttaagagcatgccctgtttaatggggatggctctgccgctcccgatggtgtcagcatgattctccggggctttcctctctttgtctgggtcactccctttctcagatgtaaacaggttggaccagcgcatggacagcttgcaaacgggggtgggtgtgttggcagtgggaggaacactgaactgagggtcctcctggctggtgctgggagtcggtggaatggaggaggaatagttatttaaactcccacctccatttcttttcttcataatgtgcacggtggaaacctgtgtggaacaggaggaggaatggcttcaaaaattgggtagtggcttgcaggatcctatagacagctcacaattaccttttaaaaagatacattttctgggccaggcatggtggctcacacctgtaatcacagcactttgggaggccaaggtgggtggatcacgaggtcaggagttcaagaccatcctggccaacatggtgaaaccctgtctttacaaaaaaaaaaaaaagaaaaaaaaattagctgggcatggtggcacatgcctgtaattccagttactcgggaggctgaggcaggagaattgcttgaacagggacctgggaggcagagcctgcagtgagccaagatcgcgcgattgcactccagcctgggctacagaaagagagtccatcaaaaaaaaaaaaaaaaaaaaaaaaaaaaagatacattttctgttgtttggatagtatatttactcacactagctcactaactaaacagagctgcagatcagttcttactccagcacattctttttacaacacttaagatgactaaatgcaacatgaaatggggaagatttaaaaaaagatggctttgacttcagcatgaaacagatacaagtgtacgatgaaaatacaacctcaataaaagtgccacttaccgcaaatgagtgtaactgttcatcaggtatgctcaaagatctatctgcatctctataaaataagaaagtgcattacttcaaaaactgttaatatcttagtataatatttgttgagtaaaatacttcctcctgtgtgctttggtgtttactttaccaaagcagtttttacaaattcttctcctggatcctgacttgcagagggtttcctgacttcttctttctcagcacatcatggtctgtaccgtgaagccttttatatgataaccagtcagaaatgcccatgagtattgactctccctaacaggccatggcaataaaccaaacatattttcactcttctaaccacacattgaaacacaagaatgttctacaaagcagtagtagtaaactttaataaatgtaaatgtgattcagatttcctagcttcctttctctttagttctctgtagtatactctcatgatgtttttatgtattttctgttgtctgaatgacaaactcatctacctttttaagaggccagtctttgaggaactttaaactttgtaaaactaatgcattgtgcctgtgtataaaccagtggttctccaaatgtgctctgtggacctctcgggatcccgaagaccccttccagaaggcctaagaggtcataactgttctttttttttttttttttttttttttttgagaccaagttttactcttgttgcccaggctggagtgcaatggtgcgatctcggctcatggcaaccttcgcctcccaggttcaagtgattctcctaccccagcctcccaagtagcagggattacaggcacctgccaccactcctggctaagttttgtatttttagtagagatgtggtttcaccatgttggccaggctggtcttgaactcctaacctcaggcgatccacttgcctcggcctcccaaagtgctgggattacaggcctgagccactgtgcctggccaacactgttctgaatcatactaattaaacctgagaaagctgatgaaaaattttaaaaatttgtgaaagtaatacaaagtcattgcctgctttttcgttgacacttgccatgattgtataaaagcaaaagtaggtacaatggctggtttctcagcataaatcaaggcagtggtaccaattacattagtagtcattctattcttcactgtcccctacaggtaaaaaacatagcctgaatttcttaagaacgtctttgatgaagcaataaaaattaatgttgttaaatcttgacatgtctctaatattctgaataagtggaaagttaatgagaagtgctttttttttgtttttaaagaatccgtgatttaactgtgaactgaaaaatcacttttttcacagaacatcatttttatttaaaagtacaactgggccagcgcagtggctcacgcctgtaaaatcccagcactttgagaggccaaagcaggcagatggcctgagctccttcaggagttcgggaccagcctaggcaacataacgaaaccgtgtctctatcaaacatataagaaaattagcctggcgtggtgccacacatctgtggtcccagctacacaggagcctgaggtgagaggattgcttgagctgagatcatgccaatgcactccagccaagtgacagagtgaaactcggtctaaaaaaccagttcaactatcattctcaaaaataaatgaagtgagaggttgtcacttcaagggaaatacgtatttgttcccaatgataaaatttaagctttcctgtggactttgaaaaacttgttccttctactgtaggcttggcagcttttcaatacttaaaggcctgttaaagtaagattggtggttaaactaaaagtgatttttgacacaataaaacataaaccaatatattccaagtaactaatgcatgatattataaatgcaagtatggagcaaaagatccatttactgtgcaagaaagatcaatgagtactgatggaataaatttattaatatgtaaaatgccaccgtaactaatttaagaaaccaccacttgtgaagttttgatttagtgttttaacaaatacccacaactgtctgaaaactttaaaaatacaccttctaccaactacatatttgcatgaggttaggtcatcttattgcttctttttctctttttttgagacagagtctctctctgtcacccaggctggggtgcaatggcaagatctcggctcactgcaacctccacctcccaggctcaagtgattctcctgcctcagcctcccaagtaactgggactacaggcatgcaccaccacgcccagccattttttgtactttcagtagaggcgggttttaccatgttggtcgggctggtctcaaactcctgacctcaagtgatccacccaccttggcctcccaaaatgctgggattacaggtgtgaaccactgcgccccaccagcttattgctttttttgtttgtttgtttagacagagtcttgctctgtcacccaggctgcagtgcaatggcacgatctcagctctctgcaacctccgcctcccaagttcaagcggttctcctgcctcagcctccagaatacgtgggactacaggtgcgtgccaccatgcccagctaagtttttgtatttttagtagagacggggtttcgccgtgttagccaggatggtctcgatctcctgaccttgtgatccgcccgcctcagcctcccaaagtgctgggattacaggcgtgagccactgtgcccagcctcatattgcttctttgaagcaaattgcaaagaaagctctagagaatccatttgtctcctattaagctcaacatgagagactttaaataatataaacaaatgacacactttttactcaactttttgttgtagaaaagttttttttcaatgaaaaacttctgttaacaatactgttctcaaggaatattttctgtttttataaactgggtcatgggttactactgacatctagttggtagaggccatgaatactgctaaactctctgcaatgcacaagacagtcctcacaacaaagcattatctagcccataatatcaacagtggtaaggctgtgaaatctaaactaaaaatagattttgaaaaaatttcaattgtataattctaccacactaaatatcaatataatcaatataaacatatactctttgagattctcaatcatttaagaattatgagagtcttaaggaacaaagaaaatacaaataatttgcttcgatattttagtaggcacaatacagcttatgatgtctagagctgtgacctaacactgagcttgatatcttgcaaagtaattagctagaataacaagacaggtttctaaaaagctcacctttgtgtgatatgatgaggtatctccaaggtcacactgtggaaggaaaacaaattcataacaatagatgttatcatttgttaggcctgcagacattttttaaaaggggggcagaggaaactctcctagcggccctgaaattcaaatcttctagttcagaacagtaccataagggcactttgttttcatttctttgttttttacaaaaatatgagaaccaaaatgcaaggaaatatgccgttagaagacgcgtttctgttggtgattacaatatataaataataacagatttcccttttatatgcttttctaccgatgaaacctttcgtcccatgcgatttattttatgtatttatttattttttgacccagagtctgtctctcttgctcagactggactgcagtggtgccatcttgactcctcacaacctccaccacccaggttcaagcgattctcacgcctcagcctcccaagaagctgggactacaagtttgcgccactatgcccagataattttttttttgggggggtggtgggtggagtttcgctcttgttgcccaggctggagtgcaatggtgtgatctcggctcaccacaacctctgcctcccgggttcaagagattctcctgcctcagcctcccaagtggctgggattacaggcatgtaccaccacacccagctaattttgtagagtgaggctcaaaacaactgagggaaggtaaatctcaattctactaataggtctacacaatattagcactttttaaaaagcctgtaacattagcatgtgagatggatatgtctatagtgcttcaagtagttttcatctctgaaataattttaaaatcacagaatttaaagttacatgctggaaaggaccaatgaccttatgtgacatttaattcaacacttgttttacagatcagggaaacaaaccttaaaactgacttgcccaaggtcccaccaaataggagcagtttctcgtcctaaactcaaattaagcagtggctctcaaactttgctgcacattaaaatcgcctgagaagctttaatatctgcctcatcttccacatgagacattttaatttaattagtattgggtatggctttgggcatcaaggttcttggtaaacgtttcccaggtgatttcaatcagcagcaaagtttggaatgattgagctggggtgaaaatcagaatcttctgggatgcttttcttcacagaaagatgcctcacatccatcccgattttcctaaaaggcttctcagtgcctagagatagagggaaagtggagatgggaagatacatgtatttgcagacttgcattttgaaaaaaaccttgcataagtgatctcagcgagttccacctatcccactgacaacagtgcactactgattcatgataaaacatttttcaatatatcttcttgaagccaatttgccctattaatttgttcaataactttatttcaccaatagtgaatacaccaaatgattatttctcaaacttgctggtggcaaattaaaacttactatactctcaaaagtagacttctaaaaagtagaataatgaggaaaaaagcacaaaattagtttcagcaaaattaatcttcaaagctgcttttgaattatatgctaacttatcaaaatctttggaactcagaagaagccagggactctagtcaaagtaatttttgtgtatgtgtgctcaaagatttaagagacttggctgactacagacatttagtgattactcaataggtcccaaagctcaggacttgagacagagtttgagttcagtttttgtttgaaacacaatttcctctcaactattgttaaaagggagggaggaaagtgacattattatgagtgtaaacttgccacttttaattgaagtaaaagttattgacaattgaattagctaaaaaggctagtgcatttgaaacaaaattgtttataagctagttatgtttacagaatgaaaagttaaattaaagataaagacattaatattctaaattagcactttccaaactgtgttctaaaaatcaagactaataacccaaggagatgagaataatgtacactggacggcccctgtggagctggtggtggtgttggttgttgttccttttaaaataaacttcatctcagggtgctctcaaagcgcatctttgtggcccacgaggtgctcatgcacaatgggagaaattcaaatgcagatacactgtggtgccagaagaagaaaagctgttccttcttccaaggataatgtccaaagtagtgcacactgatttgggcctatgatgcattgaaaaactaagtttccacaaaaaacattcaataaagggaacctatccttctcactgtgttcaacattgtctaaaggcataaagacatcaaaaagacacactgtttctgggtttgcttctttgctaactgatttttccttccaccacgacgtctaagattaaaagagaaactgatacttaatattcagaatctgaatatcaatatatggttgactccaatttcttaagctgattgctgaagaggacaaccaaatggctgaaataatttccgaataaaggaatctgtccctcggcagcatagttgtactcacgatattattgtcattgtaagataatgctggatggctgtgctgtcatcaaggaatattgtcgaacacgagctgtattgttgactgaaacgctcagtagatacctgaaggggaagggaagtgtaagtcaaacttatcaaagtgtatttttttctcagttaaaatgtcaaatgacaaagcactaagatatgtcttacactccatgaactgcctgagtgtggtatcatgtgcaatctatagaaaacccattggaggctctcaacttccagagatgatgtttaagatatgggttataaaatgctgcccttaatatggtacctgtcatcaaacctaacaaggattttatgaattaccgttaaaaataatgggaaaagtcggcttcgccgggcgcggtggctcacacctgtaatcctagcactttgggaggtggaggcgggcagatcacgaggtcaagagatcgagaccatcctggctaacatggtgaaaccccgtctctactaaaaatacaaaaaattagccgggcgtggtagcaggcccctgtagtcccagctactcgagaggctgaaacaggagaatggggcgaacccaggaggcagagcttgcagtgagccgagttcgcgccactgcactccaggccgggagacaaagtgagactccgtctcaaaaaaaaaaaaaaaaaaagaaagaaaagtttaaaatgagatttcatatttttttctacagcaataaaaagcagccaagaatttctattaattaattaattaattaatttatttatttatttatttatttttgagacggagtctcgctctgtagcccaggctggagtgcagtggcgcgatctcggctcactgcaagctccgcctcccgggttcacgccattctcctgactcagcctcctgagtagctgggactacaggcgcccgccaccatgcccggctaactttttgtatttttagtagagacggggtttcaccgtgttagccaggatggtctcgatctcctcacctcgtgatctgcctgcctcagcctcccaaagtactgggattacaggcgtgagccacggcgcccagtccttctattatttatttactacgataaaatgtagtgtattaaataatcctgctacaagagcactttattgcagtgaatacaagactaatgcatttactaaattactaatcctaaacgtattatttcaggtgatattgttacaaaagaagtgtttcagattcaggggctctgtgtgccagggctgctaggccaccaacaagtgaggaagccataggtttctctagtcctattttcttatgtggaggataaaaagagtatcacttaaatattctctcacaccctaaaaacaaatgacaacttaaaaaatctaactttcacttcatgtttaaataagactgccaagacatgactcaaatgagactcttggagaatactttgcattcacttcaaaacttgatcaattgcattctataaatcatctgacctgcacctagccattttcctgctctacccctgctctctgcctagaatactgcttttctctttccttgcttcagcaagctcgactccatctaccctcttggatctctttgtcggcagccacaccaaaaaatgtatttttatacactaattagttgaattcaccactgcttacaagatgctaattcctgcagagtattcccctcatgagaaagtatgcctctccataagagtaagggagggcccttactcttcctacctccagctgctgagcatagaattttgagtaaatccaaaacttcgacaagtgtttgacaattcagtcatcatttggaaggtaagtcttactacatttaattacagcaaaaacactactaacagtttactctttataggtattatttaaggtagtcacaaaatagaaacaaataatctaacgtcagtcagcataaatgagagtatgaaattttacaatatttaacaagaaatggaaggggttacttagtagttttaaggtttaatgacaaaaactagaaaataatcgtacctagtaatttagtaagtcaaaaccaaagccttaccatcaaaggtgcagtacccattggatgcggatgcccacgcactgacttctgctgtacctgctgcctctcattttaacccattaaaaatactaaagttgttttccttgtagacatctttcacctccttggttaggtctattccgaagtactttattttattttagtttatttttgcagctatcagaaaaggggttgagttcttggtttgattctaagcttggtcgcttctggggtataacagagctactgatttgtgtacattaattttgtctcctgaaactttgctgaattcatttatcggttctaggagctttttggaggagtctttagggtttcctaggtatatgatcatatcatcatcaaacagcaacagtttgacttcctctttactgatctgcatgccttttattgttttctcttgtgtgattgctctggctaggccttccagtagtatgttgaatacaagtggtgagagtgggcatccttgtcttgttccagttctcggggggaatgctttcaacttttccccctttcagtattatgttgttgtgggtttgtcatagatggcttttattacattgagctatgacccttgtatgctgattttgctgagggttttaatcataaaaggatgctgcattttgtcaaatgctttttctgcatctgttaagatgatcatgtgattttttgtttttaattctgtttatgtggtgtatcacatttattgacttgtgtatgttaatccatccccgcatccctggtatgaaacccatttgatcatggtggattatcttttttttattttttgagatggagtcttgctctgttgcccaggctggagtatgcaatgcggtgatcttggctcactgcaacctctgcctccgaggttcaagcgattctcctgcctcagccacccgagtagatgggataacaggtgagcgccaccacgcccggctaacttttgtatttttagtagagatggggtttcaccatgttggccaggctggtctcgaactcctgacctcatgatccgtccgcctcagcctcccaaagtgctgggattacaggtgtgagccaccgtgcctggcccgattatctttttgatatgccgttgggaactacaaaacattgctgaatgaagtcatggacacagacaaatggaaagacacccatgctcatgaatgggtagaatgaatattgtgaaaatgaccatactgccaaaagcaatctacaaattcaatgcaactcccatcaaaataccaccatccttcttcacagaactagaaaaaacagtcttgaaatttatatggaccaaacaagaaccggcacagccaaaacaaaactaagcaaaaacaacaaatctggaggcatgacattacctgatttcaaactatactataaggccatagtcgccaaaatagcacggtactgatataaaaataggcacatacaccaatggaatagaatagagaacccagaaataaactcaaatacctatagccaactgattttcaacaaagccacctaaaacataaagtgaagaaagtaaaccctattcaacaaatggtgctgggataattggcaagccacatgcgggagaatgaaactggatcctcaactctcaccttacacaaaaatcaactcaagatggatcaaggacataaatctatgacctgaaaccataaaagttctagaagataacattggaaaaacccgtctagacactggcttgggcaaagacttcatgaccaagaacacaaaagcaaatgcaacagaaacaaataggtgagacttaactaaagagcttctgcacaggaaaaggaacaatcaacagagtatacagacaaccacagagtgggaggaaatcttcgcagtctatacatctgacaaagggctattatccagaatctatgaggaactcaaacaaattacaattacaaaaatatggaaccagcccaaatgcccatcagtcaatgagcggataaagaaactgtgatatacatacatattatatatatatatatgaggaataccacctcagccataataaggaataaattcatggcattcccagcaacctggatggaagtaagactattattctaagtgaaataactcagcatggaaaaccaaatatcatgttctctttcctacgtgggagctaagctatgaggatgcaaagccataagaatgatacaatggactttggggacttgggggaaaggctgggaggagggtgagggataaaagactacaaattgggttcagcggatactgctcaggtgatgggtgcacctaaatctcacaaatcatcactaaagaacttagtcatgtcaccaaatgccacctgttcccccagaaacctatggaaataataaataaataaataaagtacagcatttttctcagcaaacataaaataaaacaaagactaaagttcatatttttcactctccttttgggcaggacaaattttagataggtttttaaagaattagtaacttttttcctttttccgagacagggtctccctttgttgcccaggctggagtgcagtggtgcaattatagttaactgcagcctcaaactcctgagctcaggtgatcctctgcctcagcctcctgagtaggtaatatgaaaggcgcatgccacgaggcctggctaatttgttatttaacctttttgtagacatgaggtcttgctatgttgaccaggctaaaaatgaacaaatcttaattaacttaaatatttctaacaccttgggcattcaggaaaacagctccatttatgttgtgaagtaatgggaagcatatggcagtggataaactttgaatgaaaatattaaacaaggccttaggagaaaagtgtaatatgcttattatagatacattaatttaaaaaattctctggcttaatatcattatactcaaattagactttgatttaaacataggtcctaaatttggattaaatataatagattgaccacaaatttatttcgtctccctctggaagcctcattagtcataaaataaaggttacacccatgaccagcacagaaggttgacagagataatttttagtaaatgctgagacataaaaagtagacaaaggagtggtaaataacacagaaacacaactttgctgactacagaaagtgactggaacagaagcgagccagtttgtcttgcagaactaaaggcaggttgtgaacttacaggcaaatggcactttggaaagtagggtaaaatgtaaaaaaaaaaagccagcaaggtcagttgcaaatctctaactagagcccaaagtctacctgtccttccatctgacaagaaacttagatgtgtgttctctggatatatcaaacctgagaatttctggctcagagatactatggcttaaacctgagatataaagaaaactgtacaccaaaaatggaactccaactttctttgctaactctgcttttcctttccaggcctgcttttactttccaggcagaaaattgggagatccttctcagaagaaactgaaatgtcttcagtaaagatccccagataatacactgaggtctcccaaatgaaaagctagtcaggcttctaaggcctcacactgagtgctatcagttaacagaaatcctgcttccaaataaagcaggccagggaccaccacacattggagggaagcctccaagaaaagagatcaaaacaatagaaaaaaggaattgataggaccagtcaaaatcaggagcaaaactttaaaaaaaaaatcttaaaacactctcaaaaaatataaaattcaatagaaatagtagaggataaagtcacagaatatcccagaactagaataaaaagacaaactgaaaaaaatagaaggggaaaaattaaaaatcaatgcaggtgtactggtctaagcagcctagcatctgaagaacaagactatcagtaaaaaagtaacagagaaaataaaaaaaaaattctcaagaagagatagtctgcaggtttagtagcctcaataaaatgaaaagatccccaacaagctgttataaaatttcagaaccttagagagagagattctaaaaagcttccgcagataactaaaacctggttgtaaataacatatcacacactggcaatagattcaagaacaacactgtaataagagcacaactgcaaaatgtcttcagaaccatacaatttagattcaacctagaggtgtactctctatcaaagaggagggattttaacatctccacccaggaaaatgtgttcaagtacaactagagacgataacaggacagaaggaaacacagaatctaggactcaggagatcccacacaagacagcagttacgtgagatcccaaaagactttaaggagttagcccagaaaagcagacattgagcatatctagggaaacccacgctatattgaactaggatgacaaaaggccaaagaaagttgccccccacacacacataaaaaggaacagatgtgtttttgcagatggaaaatatctttgaaaggcatgtgataaatgctacaatacttgggggaaaaacagctattagaaaataggcaaatgaatatagtcagaaaattagcttcatgctaaaaaataatggatgtgaaagcaaacagagcacccagaggctacttaatgatatttggatagataaactaacataggctaggaaaaaagaagatccaggagaattgcagaagtgctcagatttcagaactgtttcagagacaggatgaaggacatggaatgcagaggcacagtgaaaacaccatatgacttagcagtgaataatatttgcagagtcataatcatgtaaatattactgatttaattaaaaagtgtgctacaattggaagaaacacagggagaaacataagatcatggtgtagcgaggaagatacgcttttacccgctgtgatagaaagtcaatagacagtgctggcaattaacttaactattctatttttgttctttcattaaaaataagattaaatatttaaggcacttttttttttttttttttttttgagacagagtttcgctctgtcgcccaggctggagtgcaatggcacgatcttggctcactgcaacctccgcctcctgggttcaagtgattcttctgcctcagcctcctgactagctgagattacaggcatgcaccagcacgcccggctacttttgtatttttagtagatacagaatttcaccatgttggtcagggttgtctcaaactcctgacctcagatgatcagcctgccttggcctcctaaagtgctgtgattacagacgttagccaccatgcccagccttaaggcagatcttttgaaccagactattgaaatttaacttaaatgtcagaaatctttaaaaggtggacacgctaagctaaacacttttctggataaatttaatactcaggaaaatagaagagatttagaaaatccacaaaaagaggtccatgctaccaccaccaggtccacattgtaatttaaagaaatcaagagagacatccttttatgtcaaactatcaatttcttaactatttgagtgtttacttacatggtttgtacagttgcttcttcttatttctacaactaagaataaaaaaaaaaaaaactggtcacttctgatacaaataccataaaataaaagtagttgttaacatcttactgattactcctatgtaaaatgagacaaaattccatttaaaaaaataattttcaataatttataatttaaattatctggcatgattaatttcataagtcaaatctaaaaacttagtttttcatttagtttactttttgtttctattacatacaaatgaaagaatcctcatgtacaaaagaaaagggtaaaaaaattaggccagatgaaaaatttagctaataaaaagtttaactgttgcatatatgagccatgatccattagtattctctcattctgcatttacacatagcttactttaattatcagactctaagagctaacagctctaagaactacgtcctgaccagacacctatctctagatgcaacagaatccctgtaagcatcttgaaccacacttagtggttatctactaatatgtcactaaaaacaaatcaaaattaaaaaacggtctttacacaactggaaagtaacgtatcttaatttttttttttttgagatggagtctcactctgtcacctaggctcgagtgcagtggtgggatctcagctcactgcaacctctacctcccaggttcaaccaattcttcagccttagcctcctgactagctgggactacaggcacgtgccaccatgcctagctaatttttttttgtatttttagtagagacagagttacactgtgttagccaggatggtcttgatctcctaacctcgtgatccacccacctcagcctcccaaagagctgggattacaggtgtaagccacagagcctggcctaaattttgatgttaaaatgagtatacaaacctaattggacatggtgtctgaagctcaaaaaatcattttttttcctctaaaaagaggccagaataataaaagccccaagagggacttgggccatgctttgtttcctacactgcctctgcctttgatgctggaagggccttgtaggcaaaagttcctaccaccgaagagtgagggacatggaatagcttttcttttactgcttccatgctctctaggtgtgagaagcccatggctctggaaggaactgggaaatacaattctgatatgttttggatatgttgcccctccaagtctcatgttaacatgtgacccttaatgttggagacagggcctagtgggaggcatttgggtaatggcagtggattccttatgaatggcttggtcccatccccatggtaataagcaaattctcattatggtaatttaaaaggctgtggtactggccaggtgcggtggctgaagcctgtaatcccagcactttgggaggctgaagcgggtagatcacttgaggtcaggagtttcagaccagcctggctaacatggtgaaaccctgtctctaccaaaaatacagaaattagccaggtgttatggtgcccacctatagtcccaactactcgggaggctgaggcaggagaattgcttgaacctgggagatggaggttgtagtgagccaagattgtgccattgcactccagtctgggcaacagagtgagactccatttcaaaaaaaaaaaaaaaaaagagtgtggtaccttcccccttcccctctctctttcaccgtgtggaaccacctgcttcccctttgccttttatcatgattgtaagtttgctgaggccctcaccagaagcagatgttaaagccatgtttgtacagcctgaaaatctttgagccaattaaacctcttttttgttataaattacccagccttaggtatctctttatagtaatgtaaaaaatgaagacaaattctaaccagaaataactgactcaagatgggcaaagtctactcaaactataaaaacaaaggttacaaactcccgtgttttactgtgctgcattacttcgcacactattatagaaccctcacttgtattcttgctgtttaagtcaactggaaaacttggctgtgtatggcttgttggcaaataaatgaggatttaacataacattagggaaataagcaggagtagggcatgtttaaatttacatgacatcaaatgaaaaagttaataacctaaaacttttgagtagcatgaacttggatgtggtaaatgaatgtggtcagaggactgtgtaagaggaggcccaaatcacagattcaatccctgatgataaacaactatgttttttaatttgtttaaatgaaaaccaagctgaagcctaagttctatcattcatctttaaagtgtactttttggagcaagggaaaagggattataaataaagataaatccattaattataaataaagataaatccaagaattataaagagaaatccatgactcctccaacacatgacaaattaattgtgttgataaaaagatggcaaaatgtataaacaaaaaggttacacgttttcactaacatcataacaactaaaggaaagtatatcacatattaaaataagacaagtgaacatgtgaaaaggtgaaaaatttaaaccaatatgagtttttctaaatactttctataacctgatcaaacaagagcttttattctttctcttggcggaaaaaacaatgttgtctcaccatctgtttgagagttcctctggaatattgtgcttgcctctggattggcagaagagttaaactccaaagctatatgcatagaggaagaaaagaaaaagagatgcaatcattgataaaaatttatcaactcgtttattcggctgctgcatttaggctatttcactatctctactttgattcttatccattgaaatgaatgtatagacataagatagagccaggcaagatggcacatgcttgtagtcccagctactcaggaggctgagatgggaaaatcacttgaacccaggtcaggaagttgaggccagcatgagtaacacaatgacaccctcctttatttaaaaaaaaaaaaaaaaaaaaaaagaagaagaggtaaattttggctttgagttgtgtaaaatcaactttgcataaaataaatcaagatggcagtaagttttaaaagacagtctattttataggcaaaatataagatgtattctagagtttttaaaatttttaaaaagtaaattcatcatatctgtcacttccatttcattctgaggacacagaaccttagttctcttgagtagctgtcttccatagtcatgtgatatctctaagttttcatttcttcattagcaatacatagggagaacatacacaggccttatttgtattggaaagggccaagtgagacatacataaactgtgttgtaatcctaaagaatgacaataaagagccatttttgggctctcatccaacactacccatctactaactggtgtgtaacatccatcaggctttccaaacatcaccaagcagagtataagtttatacaagtacttacatgctttgtgtataaaggtacaatcaattaattcacacaatgcatttgtttattctaaagcaatccttaaatatcttgaaatgtgaagatagtacttccaagttacaaagtcacactcataatgagtcttaattatcctacctctttaaaaattaagagcccaaccaaagtttaaatagaagagctataagacatttcctctagagtaatgaaatctctggcatttaaatgaaaccaataagccaactggatttaatatgtttatgatgcaatgttttctattttgaaaatttcagtttttattcaagaaccatattattacccagaattacttttacttagattcatctctttgcaaaattttagaggcaaaccaactaattgttttctgttttctaccggctcccatcccctgcctctgccaacagtgtagagactaaaaaactccaactctttccttttttttttgtgagacggagtctcgctctgtcacccagcctggagtgcattggcgtgatctctgctcactgcaacctccacctcccaggtccaagcaattctcccgcctcagccttgtgagtagctggaactacagtcatgcgccactacgcccagctaatttttgtattttcttttttagtagagacagcgtttcaccatgttggccaggctggtctcgaactcctgacctcaggtgatccgcctgccacagcctcccaaagtgctgggattacaggcgtgagccaccaagcccagccaaaactgtaactttcttatctttgaacaagatgctattgtcaggaggggaagggacaaagggggagccacggcaacaaacactcttacagggaagtctgacattttaacctgcaatctttatattacacattaaaagtctacgttgacgtttcatgtcttttgaaagttttgaccgtgaaccaatccccacctctcttttagaacaaggaggtaaataaagtctgttaagtcaccagaataaatctggagacacattttctgttaaagtaagaattttaaagtaatcagagcctcataggtaaactcctttgagaaaccccaaacacacacacacaaccatttttctgcagccccggctgtgacattttatacctttcacaattattttaagcactctccttttttctttttccttctgtgttcaaattacagttagaagaaactaagcagcttctatcaaggtgacttaaagcagcccattaagaataccatatagcctctcccgtggcaacctccattctgattttaaataagaaatccccaaatatttgaataggaactgtcctgagatttggctactttaacaaaggaaacaattaggcacttacctggttccttcacttaggtaccatctggataggttcaaagaaaaattaagatgggtactgaaaagttgggatatttgagtttttattgagaaaaggaagagaatagctcaaagaagcctaaacaaagtcccacaggataataaacagagctacagacactgttgtctcaccatctgtttgagagttcctctggaatattgtgcttgcctctggattggcagaaaggttaaactccaaagctatatgtatagagggagaaaagaaaaaggacgtaatcatttataaaaatttatcaactcatttattcaactgctgcttattcgacaagagccataaataaatggtcccatgccagcctgggagaatgagatgagagagcaagaactgggcgattgggaggggaggtgaaaagaaactgactggactcggtggggaaagactaaggggtgggaattcaaggcagagccagcttttgttcctggccagcccccgggaaagctggctacaagcagaaaggagctcgaagtgtgggatgcctcaaagggaaccttggggacagcagcagccagaggcaaaccgagggtagatggcacctatcacctccttaccttcaggcatctcccggtcacgaacctggtgcatgtggaggtcctcaccaacttcaacagtcacctcagcaggctgtacagcagcagccatgggcgctcctgccatcctgtcctcagctcctgcctcatagatctcagattcagagggacacaccgacccctgctgctggtcaaactcgaggctgacgctagggtgcacacgacaggtcagtatgttccccatggggcgcctctactgtctgccaccacctgtgcctctgctcacagctttggccacgcactcccgctgtcctaggccgaggctatgctgcacttgcagagatggtcttcccgctcctcgcctgcccacctcacagtgcggccccgggcaccagccctggccccggccccggccccggccccggctagggctgcgggccaaggcccgcaccctgctgcctcccctgagttgacttgtctgggagggtgaagaccagccggcttatttaataggttgtgaacccaacaagcgctgagagacacaacaactgcctgaagagagaacagacggagctcctcctccttctgtagtcacctacagactgaagcccactggccccaggtgggagcccaggcatgtggcacacaatgccccaccccacacttcacaatgccctccccgacacctcacagtgccccaccctgcctgccacccctccccaacagctcagaatgcccctgccttggctgccccaccctgtggcttatgatgctgctgctctcctggcccctcgtgcagtgccaatgggactaaggttttcattcatcaccagcttcctgagattttagtcctaagaaaagcacagggtagttcattcctcgaagccagcttcctctacgagttctacacaaagcctcagtagagtgggtcccattagcaaccaagttgaacaacttttatttgctgtctgaatatagatacacctgaattgttgactgcttttgtaactaaacactcctctcctgtcttccaacgagtggtcatttttgtccgcaacttgatcacagcaatccctggggccctagctctactctcaataaagagttatggctgtgtgttttgaatgacaccttaggacccatcctgcctccacctccttctccataaaatagaaacctaacttgtccctccaagctctgaaatgctgaaacttaccaactcccttttctccccgctatttcttccttccatggcagggactttcagattttctttcttttactaacaaggcactaaacatgattttctcatacaaaatcgagagccataaagtggcttaccacagtcctatttcaataaagatgaatactcgacatctggcaagtagtgtgtgcctgacagtgtccccactgtgctatgctcatttaaccctcagaaacaatctcatgttacagattttacagaagttgttgggacagagaaggtaagtaaacccccccaaggtcacatgactgctaagggtggggccatagtttgatcccaggtagtctgaattccccaattgcttaagcatgattatcagaaagtatagcagtctgttttcacactgatataaagaaacacctgaggttgggtaatttttaaaggaaagaggcttaattgactcagtttcacatggctggggaggcctcaggaaacttacaatcatggcagagggggaagtccttcaggaaacttacaatcatggcagaagggcaggtccgacttacatggtggccgcacagagagtgggaacatgtgaaggagcaactgtcaaacatgtataaaaccatcagatctcagctgggcacggtggctcacacttgtaaccctagtactttgggaggccaaggcaggtggatcaactgaggtcaggagtttgagaccagcctagctaatgtagtgaaatcctgtctctactaaaaatacaaaaattagctgggtgtggttgtgcatgcctgtaatcccagctactcaggaggctgaggcaggagaatcactggaactcaagaggcagagactgcagtgagccaagatcgtgccatggcactcctgcctggacaacagagcaggactccatcccaagaaacaaaacaaaacaaaaccctataagatctcatgaggacttactgaatatcacaagaacagcatgaggataactgcccctgtgatccaatcacctccccctaggcccctccctcgacacatcgggattatggggattataattcatgatgatatttgggtggggacatggcaaaaccatatcagaaagtaaaggtagaagtcaagcttggatgggaaatgacattgtagattattattattattattattttgagacgaagttttgctcttgttgcccagtgaaattgtttctctaatttcattttcagattgtgtcttgtagatgtatagaaatacaattgataaatgattctggctattaaccttttatgcttcaaccttgctgaacactatttttttttttttttttttgagacggagtttcgttcttgttgcccaggctggactgcaatggcgtgatcttggctcactgcaacctccgcctcccgggctcaagcgattctcctgcctcagcctcccgagtagctgggattgcaggcatgcgtcaccatgcccagctaattttgtatttttagtagagacggggtttctccatgttgatcaggcccacctcagcctcccaaagtgctaggactacaggaatgagccatcgtgcccagccagattcgtatatttttaaaagaattttttttactttttattttttttttttttgagacagagtctcactctgttgcccaggtagtggcacaatcattgctcactgcaacctccacctcctgggtccaagtgattctcattcaagtgcctaagcctcccaagtagctgggattacaggatcccgcccccatgctcagctaatgtttgtatttttagtagagatggggtttcaccatgttgctcaggttgatctcgaactcctgacctcaggtgatccacctgccttggcctcccaaagtgctgggattgcaggcgtgagccaccactcccaaacagaacaacatttttttgatgtggattttaaaatgcctccccttctttcaacattaagtcccttctacatgccaggcactgtatgtgtgaaatagtcccaactctcaatgagtttaggcagatacacaaacaaaggcttaaggaggtcagttttctgagaccatactgctggacagtatatgaacctgggatacaaacccacctctatttgacctcaaatttgatgctggggtggttttaattttattctgggaatttcagtcattcaaccataaaaaggtgaaaagtctctgtcagatgtgcgtgtagtggtctgtataataaagactgaaggaagcaaccaaaccaattaagagactttctctaaaggcagagtaatgctaagggcagtggcagtgacaaaagtggaggaaaaagtctgtgatcatttgggagacagaataggaagtgcttggtcatgagatgtgaaagaagaggggaagtagaaggaaaacagagctgctcaggctctgctggggaagactgggtatgtagcagtgccttcctcctggccgagaatgtaggaagagaaataggtaaggaggaaaagatagttttttactctcagtgtcacattaaaatggaactctctggtcaaaagttgaatataaatctctgtaggctaagtccatttgtgacatcccaacatatgttttcaaaaataacatacacactaaatcaagccattaagcgtaactggggaaatttcctaaaatttacatgctaaaaaatcaccatttttcatttattactttcatggagcaactttgaatctatggttacagcaggtgaggcaccttgtataaaataaagctaatacatgaaataaaaccatttaaaattctattgttctcagagaatggagaaagcaattgaagccatgggtgtggaggtgactgccttgagaagttgtgtatagtaaggagaactgggaagaaagaagacctggagaatagggtgatttgcacggcattaagtgaagcttgaaaaagtgagcactgggagtcaagagacatgtatgaatcaggaatggctgctcctgtgagttgttagaaaggagatgatgccttcttttcatatctataacagtagcacctagcacagtgcctgttcaataggtactcgacatgtattatcccaatgcagagtcaaattttgccaggaaggcaggaaagctacaaattagctatggcaacttagtgattgggcttgtgtgtgtgtgtgagtgagctggatgtcaggcagtgggcaaagtagtgaactggaggtgagaaaacaatgacacaaactcagggcttctcttcccaagtatttggctgagaagagagatgtagtattaaagggagatatgtggtaaaggaagacttttatttcaagattcaacaaaagcgtgagtatacttctatgttaaagggaaagagccaatagaaaaaacacatttttgaggttagaagagaaggaagaactaatgcagaagggccccaaaaggcacaggtgcgtgcaatccggatcagggacagattagctttggattcctacaaaagcaagaagggagaaaggaccatgtgacactagagctatttctggtaaaggaaaggtttgggaaaagatcttttgatcacctttattttaacagaatgtttttttttttttttgagatggagtcttgctctgtcacccaggctggagtgcagtggcacgatctcggctcactgcaacctctgcctcctgggttcatgccattctcctgcctcagcctcctgattagctgggactacaggcacccgttaccatgtccagctaattttttgtatttttagtaaagatggggtttcaacgtgttagccaggatggtctccatctcttgacttcgtgatccgcctgtctcggcctcccaaagtctgggattacaggcgtgagccactgcacccggctagacttaaaaaaaaaaaaaaaaatactgtgggaaaaaggatattatgtatagaaaagtctacacttcttgatacaactaactaaaaaaagcctgatacactaaacaaaacccaaataatgtcttccctaaaagtgggtaacttgaaaagcaattcgagcaaaaatcaaggagttcaattataaataagtatatcaacaaagtgaaagatgggtttaatttttcccacaaaaagttaaaagaaataacagcagttttagaggaagaggaaaaaataataagaaaattacatgcagttgcaaaatgtgtgactatttacaaactctaacatataactacaaaacggaccagaagaatcattatcataggaagcaaagggtcatttcaaaaatcagaggagggatgattcatatttaatttaattctgtggaaaaaatttaagtaacctttgaggacaaaaataggtgatatgttgaaatgcgggaaaccacagtggaaggaaaaagaattcaagaaagctcagtttcagtaaccagtatctagtaaaatcttcaggacctagaggctacaatctgcattaatagtgtctgaagacctagaaatgtcattaaataccattttggataattcttgtagacttgagatgatgtctatttaaagttacaaaatagtgcccgtatttctgtattcattacagacaacaattggatatggaaaagaaactaacatgctatgccacaatctctaaagaaagattagggatgtttcagcttaaagcaagaataatcacaataaagttttacgaccctttgcaagcatatatgaaaaacttacaaaaagtttgtaatgatcttttcttaagctaagagaatggaaaaaatgagaaaaattaaattataaaatgaaactttggtttagaggtaagaaacatttgatgacagtcaagagatcagggttgtacagtgtattatgtgaatgttgtgactcattggtttcatcttggatatcataacttgacattttgtaaaagtgatttttcatgggagttttttcaggtgccctgaaaagtcctgtcccatgagaagcgaataatagtcttccatattcttgcgatatcttaatgaatagcatcttctacagtcttccattgtttagtccttggagagacactgactgaagctgtgaggtttcacaatgacatgtcagccaaatacatatgctcagatttaccatttatcaagaggtcttcacactatcaattgtgcaattatcattctacacacaggcagtgataaagggagtaaaaaaccacagccatggatcgggagaccaaggtacctccagaggagtccagtgggtccagaagccctttggatgttggtcagaggctcctcttgggcagagatcacagcagcagccaacaggtctggtgaaatccttaagagttctcatggacaaagcttgtgaaggcatcttagacaagatcttgtctttgctggttttatgatcctctgcagatgggtctattctcattatctcagccacctttcacttcctatcagttcagttcaggtctctcatgatcccaggcagcagtagttgttatcacgtgagttcattcatatatgtttatctctttggggatggggggacaacttcactgtggacttaattctactggagatgagtgaccccattttaagacaacaggatcacaaattattatcacatatcagcagggcagacaatagctacgacctggggctgaaagcaggtaactccatttatcctgtaaacattgtcttgattatggtgccagttgctgtgagggatttcctttccaccacctgtttttcacaaggtttgagtctgaactgctaacattctactgatttctgggtgaagggactgactgcaccatcctaccctgtcagagcacttgccccagtacttccactttaagagttttccaccttgtccagaactacagtccattaatcccctcattttctctcttaagagaataaacaggccaggcgcggtggctcacgcctgtaatcccagcactttgggaggctgaggcgggtggatcatctgaggtcaggagttcgagaccagcttcgcctacatagtgaaatctcgtctccactaaaaaaaaaatcacaaaaattagccgggcgtggtggcaggcgcctgtaatcccagctactcgggaggctgaggcaggagaatcccttgaacccgggaggcagaggttgcagtgagccaagactgtgccacagcactccagcctgggtgacagagtgagactccctctcaaaaaaaaaaaaagaaaaaagagagaaaataaacaacacatctcaagtacacacccacatccctcttatcccaaataccaaacacacaaaaatccaatctgtctccttctacctaagcaattttagatagtcactgtctcataattaccttaagctccctgacttgctgctcatcctttctctggcaaaatctcatccttggatgagcccgactttgtgtttgctcaatgacaccactcacctgaaccagaaaaaatatcaaaaagtggtcagagatatcatcataaattcaaattacttacacaaaaaattggccctaaatgtttccagaaatcaataaaagttttgtttctccaatgacatcatttcttcagaaacccaatgtgtataacctattttttctatgttcttctaacatttattcaacttctctcatctgatatcttgccaaatcattcaaagagaaaatatatcccattaggcaagagcccaccatattcccatcacctgagaaaatcatatgcacaggatgcacccacctcacctttctctgcctcatcatgtcagaaaaagtaccccaccttttgtcacaaggcaaacctgagataaaagatttagatggcctgtaattccagcacttggggagaccaatgcaggcagattatttgagtctaagagttcaaaagaagcctaagcaacttagggaaactgcatctctcaaacaaatacaaaccattagcctagcatggtggtgtggtggcacatgcctgtagtcccagctactcagggtggggagcactgaggtgggaggatcacctgagctggaaggttgtggctgcagtgagccgtgatcacgtcactgcactccagccacggtaacagatatttttaaaaggatcttctctgttaaaaataatcaaataaacaggtggccatgaggctgaggtggctgccgtgcactcaattcctccttaaataaaccaaaacttgactcagtgtaaataataaaaggaaatgtaagaaccaatcagaaaccaccaactaacatctaactagagaccttccactgtaatgttccaaatgaggccactgctccacttcacccaatcaagtattttctttttcttccacattcaccatataaaattcttcccccaccctccctaagcctctctgtgggacctctgagctgcttgcagtctggggctgcctagtttatacatttctgaatgctcaagtatattttctaatgtttcaaagtggctctggtgtaggaggttgttggtggagtgacccgagagtatacaggaattgagggcatatgagatctctggactctgcactccattttgctgtacactcaaaactactctaaaataataatatatctttaaaaatctataactagcacgtagcccttttcaagcctccaactggttggagccagttcgattaaagctcagaagaaaaactggttaataagctagttctgacccaactggcaagaagcggcaggaaagacccaggccaggggagcatattgcacatgcatgcaccaggaaactggaggaagcttggaggccctttagcctggtcctgagcccgctgaaactgcagttacagcacagatgcctggggcaccaatctgaatctgccaacatccaaggccacatgaacacaaatgcgcagtctcctctgcgatcggtagctaaggatgttaggccatgattggactaggatgggagatgaactgagaactatggattctgtaggttgttgttgtctcttcccaccccaagcaacaagtgatgaacacacacacacacacacacacacacacacacacacacacacacacatcccgtagtgactaacaggatctccctccaggggatttgcagaaaggggagcagaaaacatcccaggggcctttcacagctacttccttgagccccctttcagactgctgtctagacctgtcgcagcccaaacatcaccaccctgatatgcagaagctggcatccttacctgaaattcaacaccaagaaatgatctcttctactcaacactgatagaaatacctctaagcaatgtcctcattggcaggggtggagtgggggagtttcttaaaaagtgaggcctctgcctaccacctagagaacctggaaatttccatctgtgccacaaagtccaaatcactggccactgccccagtgtatggcagattagaacatctctccattagatctgggtttctattccattgagtgaaatggcttttctattacaggaacagaataagggatcaaaagggtcttacaactgaactccagtgtacagtctgcacagacactaggcttgtgcaaatatgacacagcgaggccccaggacccttaagccagctgaatgtactgagtttcaggaaacagtgagatacgttcagcaaaacagtgggcttcatgctgaaagaagtcattccaagtaaacacacatcacacacacacacacacacacacacacacacacacacacccccgcagacaccctagtggccaataggtcctctcaccaaaaacctgtgatcaggagagcagaaagcctcccaggggtccatcactgccctttctggagccccttatcagatggccagccccaggacagcactgtctgatcctggtccagtccaaaccaccatcaccctgtgatgtgggagctggccacttcaccagaacctctgtgtcagaaaaatttctcttccttttaaaatgatgagggggaaccttcagacagtgtctgattagggtgggtggagagaggggtttcctagaaagtcaggcagggcagggctgaagccctctgggttaactgagtgcttttgatatgaaggcaggtaagactggacaggtgggggtgttagtgaggggatggtgtagggtgtgctgaagaactccacttgggctctccacaccagggaaaatgaccataaaacatcccatcttcactgctcagagaaggctagatctgctgtgagctagaaagccatgtgggggcagctgatgagtcatcaaatgggagaaatctgagagccatgtgttccacaggcctctggtccttgttcaggcagcagggcactgtgacatgtggctccttggccccttccagccaccaccttgattgcatgctgcagggaaagagactgaagaccaagaatggggtcttgctcaccatgggatgatggctcagtacagagctgagctatgtatggcccaagaggcagaatgtggggatgacccaggctgagctgggggatccaactgaacatgcacttgctaagaagctgtgggctatgatgccttgggaccccagtctgggtctagaattgtagcaaaacaggctactggtaaaagttcttgagaagccaactcacttttgctgtcatccatgggcaaacaaaccaagccccaccacttcccactccctctgaaagcctcctgcccctctgatcgaccacaccacaatggtgtcactctgtaaggcacaggtagacaaggcatccagccatgaacactccagggcgcacacatgtccagaatacgctggttcttgttgagactccactcttccaactcagacagaagctccccaatctcctcagccactcccaacaactggaggtctgaaaactttcatgcatgccgctatggtctaaaccactcgtggcggttttcattttcattttcctgataatcagtgatgctgagcacctttccatatgccttttcaccaactggatgccttctatggctaaatgtctattcgaatccattgcccatttacaaatctgcttttttgtgggcttcttgatgtttttctctttttttttcctatttatttatacaagttccttaggtattttggatattttttaaaatcattttcaattccactgcccagttataatttttttttttttttttttgagacggagttttgctgttattgcccaggctagagtgcaatggtgcgatcttggctcacagcaacctccacctcccagagtcaagcaattctcctgcctcagcctcctgagtagctgggattacaggcatgtgccaccatgcccagctaatttttgtatttttagtagagatgggttttttccatgttggtcaggctggtctcaaactcccggtctcaggtgatccatccacctcggcctcccaaagtgctgggattacaggcgtgagccactgtgcccggccaattatccctttttgtgtttttttggggggttgggggaagaacagagtctcactctgtcatctaggctggagtgcactggtatgatctcggctcactgcagcctccgcctcccaggttccagcgattctccggactcagtctcccgggtagctaagatcatgggcgcgcaacacatgcccagctaacttttgtatttttagtagagacagggtttcaccatgttggccaggctgttctcaaactcctgacctcaggtgatccgcccacctcggtctcccaaagtgttgggattacaggcgggagccaccactcccgaacccattttgtgttttaacatcagtcaacactcctattttaaaataataacaatgaatggcggtaccttagaacaaaggaattatagatctttctcttgtcttagtgcagacattttgtctataaaatgttattcacagatgaactcatgagaacattactgtgaattttaaatccatatacaagtgtatgctcattcatgaatatttcaataaaataaaactaatagcaaaaaagaattccagagttgaagcagtttcaggaaaaaggagttggcagtatgaagtaaaatagcaaaaaaaattttttttttaaatgggtatatttgtgtctacaacttttttttaattatagcattagacaatgtgtatatagatacgtatataaagcaatggaagtggcattgttttcatactagtctagaatattaaaaaatatgtaatatgtgatcagcaaaataatggccccccaaagatgtccacagattcctagaaccttacatgaaaacggtacatcatgcatgtgattcaggtaaagaccttgacatgaggagactaccctggtgctatggaatgaacgttgtgttccgtcactgttcatgtgttaaaatcctaaccctcaaggtgatggcattaggaggttaagccttacgggagactctgccctcatgactgggattagcaccttattaaaggcacaagggagcttgtttgttcctctcaccatgcgaagacacagcaagaaggaagcctctatgagaaagcaggccttcaccagacaccaagactgccggcaccttgatcttgcacttctcagcctccaggactgtgagaaacaaagttctgttatttataagctacctggtctaatgcatttccttgtagcagcctgtatggattaggacagtgggctcatgtggatgatgacggtgtctccattcaggactaagtaagcacatgagtccttaacagtggaagagaagggggaaggaaagagccacagagacatgtggccatagaagaagggcccatgggatgcaaggttgctaatggtgagagtggagaagagcccaaagccaaaaaatgcaggcagactccagaatgtggaaaaggcgagaaaaaagatcccctagagcctctagagatgaaggtagcctttccaccacctagattttagcccagtgagatccacatcacactctgacatacgggagtgtaataaatttgttttatgccctgacatactggtagtttgttgtagcagcaatggactagtaatatataaatatatatatacacacacacacataaacactacccccaccaccacacacacaacataactatctatatataccccgcccttcaaaactgaatcagataaactacacattagcattaacttagctgggtgtggtggcacatgcctgtagtcccagctacacaggacgctgagagggaggatcacttgagcccaggagtttaagatcagcctgggcaaacacactgaggccacatttcaaaaacaaacaaaaaacacaacaaatatttgattaagctcatttcccaaatttgaagaggaaacaattattagataaagaggagaaaagagaaaggtagagctgctgacttctgtggtggaagcacaggcacaggcccaaacatactcctgtcctcctggctttcctgtcccttctcataagggacacaggaacctctcaaactgaaccatggatcacagaaccatactcagaacgcaatacagttttgtctacaattttttatatatctgtgtccctgtctctgcctcccattcccaactcccttactcttgttagaaaaaaatggctattatcaaatatgagtacatccttatatactaatgccaactgatcaccagctggttttcttcttttacaaagtcataaatatttaggctttaacacatcttccaagcaatagaatgttattttccagttcattaacacaaattctatatctaaaatgaagacttcacaagttgatttaaataacatattaacgaaaatcgactggccatggttcaaactgacattttaattaaatgtgatgataggttgagtaacctagcagtactctaaaatgacttttggttatggctttttccatattatgcttaggctgaggcatccctaaatgattcaattgtaattccccttcttaaacatgagatttatctttacaaaataatttattttcttaaaattacaagttaattctatagttcatgcatacataatctcagtagatatcagctgtatgtgtacacacatacatataggtatttgtatatacacatattacataatttaaaaaaaacttattagcagggtacaaccacgaagacaaagaggctttgtgtaatgtgatggaaacacaactgcaggacaaacaacaggctgctgtgagggctgtatttaccctttctgatgtaagacttggaaaaacatggatactggatatctaatccccataacagaaaatttagggtgcagaaaacttcccacaatttttacagacaatgtcaatagaaaggcattcaatgcagggaatacacagtgtgacagtatacaaaaataagcaggttgatggtttagatttatgagacaagagaaagaaatagtagatgatgtcataattctccttttatggagttatgaaaattcttcattttatataaggtcaggtgctttcaaatgtcaatgagaaaaatatttaaaggaagaatcaaatctaagacgtagagagatctttataaatgtgaacttcaggccaggcacggtggctcatacctgtaatcccagcattttgggaggcctaggtgggccaatcacgaggtcaggggatcaagaccatcctggcccacatggcgaaaccccgtatctactaaaatacaaaaaatcagccaggagtggtgacgtgtgcctgtagtcccagctactcaggaggctgaggcaggagaatcacttgaacccgggaggcagaggttgcagtgagccgagatagcactactgcactccagtctggtgacagagcaagactccatctcaaaaaaaaacaacaacaactttttttcatgctgagaagatataatcatcaacacattcttgagcacaactatgcacacaggcacttccgcattcacaagccatgctgtgtgcacacactgatgcccctagattccttttttgaagaggtggtctcttggtgtgtcacccaggctggagagcagtgttaggatcatagctcactgcagcctcaaactcctgggttcaagtgatcctcctacctcaggctcctgagtagcctgaactataggaatgagccaccatgcccagccaatattttcatttttttgtagagatgaaatcttgctatgttgcccaggcgggtcttgaactcttggcctcaaggaatcctcctgccttgccctcccaacatgctgagattacaggtgtgaaccattgtgcccagccaccggattctttattaagaagaaaacttgtttgctgacatgtaggcaatgaattgatgaatagtagttcataaattactaatttacaagtcaatataaatgagttgagtaaacacaaaataacagcataaattaataaacagtttacgacctcaagtttctttttttcctttaaaacattgctctgacagagactactacttgtccattccatggaaaagtcagaggtggttaaaatgtcagaggtacacttattaacaccttgctgccttttgtgtagcttcctctcagtacttcaccagttgggattgacacacctctccagctgggttcaggagccagacaggagcacacagaacagggaatccaaagccatctctgacaccaaaagcaatgaaaacaaaaataaccaaacatattatcaagaaatgaacaagagatcgatatcaagtacagcaaaaagagaagaaatcacttaatctgccaggctttcattctgacaaaataatttacaacacgcatgtctctatctgacatgtgtgaatagaaaaataagaggtgacaatagagtagaggattcgtcttccaattgtctctgatctatccaacctttgttacacatcagagagctctccaatttataaataaacaacagagatatgcggcaaccaggacacagagacatactgagagtactgctcagctctctgcctaggcctgattctgatgatccctgacaatgagcactgtgaaatttacagcaaatcagtacacatacacacaaacacacaaaagagatacttcatgggcaaaaagcatcaaagatataaaataaaatgcctgaaagaccataaaacaacttctgatgaaatgctgttttcattttgcagtagtaaaatattcaccaccaaatctacaattagcttaaaaattacaataagtacagtacttttggatcccatctccaattcacaccttatcaacatgtaataatcacactgcatctacaacaaagctggatggactttatgtgctgaatacaacttgtacactaagaaggaaattttttgaaataatgagaatacaaaatttgtatgccatgctctacttcacaagttaaaagaaaatacaatcatttctatttttaaaatgcatcgaaataaaatacagaaaagagtattctaataccagttaacattaagagaatatatctctaaaccaaagatcttggatcttctagaaagacaaaatcagctggtatatatttggataagaaaaaaaaattaagagatcaagaaaggagagaagacgttcgcacagaatcatctccaaaaatggctttctgacgcattcgaccagttttcaagtctatttgtttttcctcctttggcatcaacagcctatatcaccaaggatatgcaaaataattcaatttgtacattaatcagctaatctagaactggaaatatagtcaatgaaaatacaaaagaaacagaaaatgtcaatgaattgcttaagatgtttaagatgacatagcgtagggaaaaaatgatctgataaacaccggaagagttaataaggaaactgaggcatggttccctaacaccacacttcaaaagaacttatagagagaataaaggaataacccttaaaaaaaaaatctaattttagaaaaaaattgctcaaaagggaagttagggttttatagatcttctggaaagctgattaatttctaagctaaaaacgcatgatccttaagagaaatggctgagtccaggcccaaggcaggaagaggacaaaatgagcctggatcctctggttctgtcagaaagtaagaaatgctcaaagactaacagagacagttgaagggacacaggagacaggccgaaggctcccgcagccgaatctgggacagcataggcatcagaaagtacaatgacagtgatggaaaataacccatggaataaaacgcaagtgcattagtcagccgtgatgctgaaacaaaggggagaagagaaagctctttgttaaaaatgccaggtaacaaacttagaaggaatgacagaggaataacatccattttgagtcaccagtgccataactgatagagaagattatcagggggctaaaatcactggatgaaagaaaactatatgaagctttttaacgtagcacaatagataaaagtatgaaaacataaattagaaaaaactaaaaatcataccataagggatggataagttagaatacaggaataacaggccaggcatagtggctcacatatgtaatcccaggattttgggaggccaagtcgggaggattgcttgagcccaggagttcgagaccagcctaggcaacatagtgagaactcgtccctagaacagaacaaaaaaaattagccgggagtggtggtgcactcctgtagtcctagctacttgcggggctgaagcaggaggatcacttgagcctgggagttcaaggctgcagtgagccaagatcacaccactgcactccagcctgggagacaaagtgagaccttatctcaaaacaaaaacaaaaacaaaaacaaaaacaaagaaaccacaataacaaaaaaacactggtaacaataaaatcatgattacataaagactgtatagaaaaaaaatcctcagaatatagaaataaaattatgtattttacctgtagctatattagaagagagtattcttgtagacaaggatgactagaaggatatgcaaaaatgaaaacagctaataacactcattacgtcaggcactgtggtaggtagtttatgcacattgtaacaaattatatactacattatctcaagattttcagataaattttactgggagtcataaatcaatacaacaaaatcaatgttttgcaaacatccactaagcataaaggtatacaaattcccaacccagactgaaaaataattcacataagccacacattagtggaaacctacccatgggagataatacaacataatctaaataaaactttcagagacaaggcatgtggcttctggacagccacaaactccctgactctgctctagtgtttcggccatcaaaagaaagccaagtggcctcaggtctctgaaaaaccaaaaaagcaacctatggaagatggcgtggtatttgaggaatatttgaagtctgttgaaaaatgcatcctgtattttttttcaagataagactcccttgtaatgtcaggtaagtgaagagccctcagagacacatgcacacacaaagaaaaacaaaacgacatagaatgaatcccaccaaaatgtgttatgatggcagaattatgggtgatacaatcttctgtaatatatctttttattaaaaatagaaaaaaagcagacttacccttgattatctatagcctctgacccaagtggtttggaattggaaagcagcgtcactcgacttgaagccatcttggcatcaatggtggagtaggtggagatgagactctggaccagctcatgggtgagccccaccttgtcctatcaaggccaccaagaaagggcacgtgaggaaagcacaaagatcctggagagacactggtttcactcagtttctcaaaattatcttagacacatttcctgagatcttttcttaatgccacaaacaccagagaagaaaatccttataacaaagcttgaaatggatccccatctccattaaacttgtccaaagctcagtgagtatataacctgataacctaaacacctagctagaaaaacctcagttccagtgctacaacagtgctagcttttctaacatttttaaataaccctgcttttaacccaataaaattcaactacagaactaagaaataaatattggaaatccactttaaaataatgaggagaccactgtgattgagaaaaagaaaaagacaaacgagagctggaaagcacactgattttgtagaaacagaaataagccgtgcaggtgccacactggcagcagtgcccgcgctggggccacggatcaaggaggcatggaggacaggactcttctgcttggtacaatgaaaaaatggtattctttttattctacatattgacaatatgcatttgggcctttattataagtacaagagaaaaatcttcaataaataaaagctgagtacattactttttttgattaaaaaatagattaggaaagaataatgagagttcagagcaaagactcctgcctcactgatgcctgaaaaccgtggctgccaccaaggtcaacacagacagcgtctttgtcatacagcacaccctcaactccagaaacaggcacataaaccagctgctccttcttatttaaacagcacttcttttgttattcaggaagaacacaagggtctgggaggaaaccgatgtcactcatggcaaaatgttctacccctggaagacgggacccaaaaagccagcttcaactgacaagaagtcagtaagtatctactgttgactggggggttaaaaacgatccacagtccaagggcttaacccatgaccctaaagaagggcattgtgccacactggaacagtggccctctagctacaagaggtcagagaagagggattcggtaacacctttgcaggcctacacatagctggcttacttttaaaacctccagcaaggccatcttcccttgtttggtcatttttcatttttcctgagaaatgaagccatcccaagaatcctatgtgcaattctagtatgttctacaacaagagaatacctggcatgtgaatttggcttttatctttgaagtgtgctcctcttaaataaccataaagtgacacctgccggtcacatttgatgtttgtttggatatcctccgggtttgtcaaatcttccatcctagaaaaataaactcaatcatacagcagaaacgaatgccaaagttcctatacctcctttcatgtgtcaatgactcatcacactcttgtccactaagcacatcacttaggaactagaaaatgcagaaataaggaagcaccgttcaccatccagcagaggaaaaggggcaggcacacaactgtgtctctaggctgaaagtgacattcattccataagacaccagatgggagacgacgtctacctggggtcagggaagagtgaagaacatatgcagaaaatccgtttctggaagagggtgagcctgtgctctgggatttgtactgtggcttggattctggcaggtggaaaaggggtattccaggctgagaaaatcacagcacaaagaagagcacaaaggaaggaaactgaaggcacgcacgaaggactccagcacccgggcacgaaggcagcatcactgaaaaccgaggctgaacgtaggatggggccacatcctgtagccttaaatgcttccaagtcctcccattttcctaaacatctcataattaatttactcccaaaggcacagcatctttgagcaatgatataagtagacattttccatcaactgcacttctacccccactattcaaataggcacaaaataaatcctatcactgttctttttctagcctttttagctttgaaatacatggcccaggaagaaaaagtttacaatcactttttacctgtctgccaggatataagggtgaaaagtttgccatgagaggcctaaacttcataactgtaataaaatggcccagattgtggatttcttggttttgatattctccatgcaccattccagaaaggtagaacagtttggcaacctaaacattaaaggaaaattaaaaattaaatttcaattaaattctcgtcaatactgcaacaaaataaaagctctaaacaagaagcaatcctaagaagggagacttccagcaaagccactgtcctgaggcttccagagccttgctggattctttcaggacttattagaaccacacagaggcagactgctctgcaaccaagccggtgcatctgtctaagtatggtgaggagagggaggtgaggcctctgagcacagaaacggttctgtggccgatggaccacagcagtatggaaaggaaggggcagtgcctggtcctgtaactgggagaaacttctgatgtactctattaagtcccgactccaaaacacccagacattgcctggtgcagcaggtacggagacaaatgagatacaccaagaggcccagaataaccactctcttgagggacaccttccagagactgggaacacatacacaaagggaattcaggaggcaattcctagagagatgtttagtaatgtctcttcagtctttttgtttgtttgtttgtttgtttgtttgtttgagatggagtctcactctgtcacccaggctggagtgcagtggtgcactctcagctcactccaccctctgcctcccagctttgagcaattctcacgtctcagcctccctagtagctgggattacaggtgcatgccaccacacccgactaatttttgccttttgagtagagacagggtttggccatattgccctgagctcgaaactcctggcctcaagtgatccacctgactctgcctcccaaagtgctgggattacaggcatgagccactgtgcctggcctctttagtctggttttaaaggattatactgttagtgtctaacaattatttctcttcctacctggtaaacttctgtccagaacctgtgttttaatcgcttctttgtcttcttcagttgcttgttatgcttgaaggagtcgaggtgggtgagaactcccagaattttaggaaagccatgtgcttgacagatgtttagaaactcaaacatttccatttcaaacccaaagctggcatctataagcatcagtacctacaagcacaacacattatttctcgaagaaactaccaaaacagaccacctacactaggggttggcaactggcccacgggccaaatccagcccatcacctgtgtttgtaactaaagttttattggaacatagccacattaattcctttacatattgtctatggccgcctgtgcactacaactgcagagctaagtagctgcagaagatatgatccacaaagctgaaaatattcactatctggccctcgacagaaaagtcccactccagactaaatcaaatgactacacaggcatcacccagacagagaaaccaccaccctctgacttgctctaaaaggcaaccataagacaaggccactaggatataaacatccattttaagaattctaatgcatgagaagtaactcagaaaaggctgggtctaacctggcccttacctaagaaatcctaatttaaagaaatgaagttttctgtaatgtatttttaagccaaataacaggtctctgacatccaaagaatgggaagaaagtgataatcaatgaaatatattaaatacgtacagaaaaccaacctcttctttcaatctcctcacagaaaaaaaaaaaaaatctttttttgctgggaagtatacaatggaaacctctaacttgtatgttaatttgtataactcaattgctcagaaatatttgaaatagctaccagtttagaattaagtaaaaaaacagaaagattatgatgaatggtagtctataagaaaatataagcagataagaccaatttttttttttttttttttttttgagacagagtctcgctctgttgcccaggctggagtgcagtggcttgatctcggctcagcgcaagctccgccccccggattcatgccattcttctgcctcagcctcctgagtagctgggactacaggcacccaccaccacacccggctagttttttttgtatttttttagtagagacggggtttcacagtgttcaccaggatggtctcgatctcctgaccccgtgatctgcctgccttggcctccgaagtgctgggattacaggcgtgagccaccgcacctggccaagaccaatttttaaaatttaagacacttcaaagatgcaaaataatttcagaactgattcctggaaacttgtaattttaatactaaagatagttctgtttctatctttccatggataactaaaaataacacaaaatggaaacagaaatgcccatccttgattaaactaggaaacattcaaaacccaaaaccacagaatatatgaagttgggcttgtaggaaagcacagctgccactgcagaccaaggcagcaagcagagctctccagcaacactggaccagctcaaagaacaggtggaatatcctcacaccacatctgatgccagagtgccaagggacaagcagctggttgtagggtcaggaataaaagggagcaaacagtccctcagctgccaatctttgccatctaagccagtgtcactcccctaatccacacacgcacgtacacacccaaatccacgtactgtgtgtgcctctgctgtactcaggaggctttgacaacccagagcagagcaatcaacataagctagactaaataaattatggtgcatccacagaatggaatgttatattaaaaagaaggaggcagagctacagtacttactgattatacaccttcaagatatattacatgaaaaaagcaaagcatagaacagtgtataaaataagctaccgtttgtgtttttaaagggtggcatgtgtgtttatatgtatctggaaggatatacatatacatatacatatatataaaggtctgcagggacctgagagaccagaggttacagcaaggaaagagaaaatgcgcattgtgtgtaccgtgcattacagttagagtgctttaccaaatgtgtgtgctccttttgaaaatcttaagatttacataggcatctctctcaatgatggttaagaggctgggaaggggagcagggagggagggacaaagagggaaaggttaacaggtacaaaaacacagttagatagaataaattctagtgtccaacagcacaatagggtgactataatttattatataattcagaataactaaaagaatgaaattaaaatgttcctaacacaaataaatgataaatgtttgaagtgacggatctctgaattaccctgatttgatcatcacacattgtatgcttctatcaaaatactacatgtaccccataaatatgtacaactattatgtatccataataactaaaactaaaaaaatgtaaatgcatctcttaatatgtatgtgtttaaaattagaaacttgctacattttaaataaaagagaaacaaatgacttctatgaactattcaatcatttcaagtatacaagtttagtaatctttacacaactttacattaattacacttatttttactaatagtagcattacatgttcaaaatttgaatgttatttagttttctgacattacaatggcacaactttaaaatctgtattactttttcctttatattttaggagtcttcctaggccaaagtataaaatctgtagctctagcaaaaactaaataaaaatgaaaaaaacaaggtatctgtcaccctacacctcctaatcaatatggcttatttttttgctaatttttttttttttttgagacagaatttcactcttgttgcccaggctagagtgcaatggcacgatctcgcctcaccgcaacctccatctcctgggttgaagcgattctcctgcctcagcctcctaagtaactgggattacaggcatgcaccacctcacccgtctaattttgtatttttagtagagacggggtttctgcatgttggtcaggctggtctcgaactcccgacctcaggtgattcacccacttcggtctcccaaagtgctgggattacaggcatgagccactgtgtctggcctttttttctttttttcttttttttgctaatgtaaaagatcatagaatatcagagatagtgaacattatcatttccataaatgtacattttccacacgctgagtactatctaaattttctattgataaactctgaccacttcttcaggcaattcatgtacttactttagcattatcattaaggatgaaggttctagaaccatcaggaacaagggtcccatcttcacacaagttacttaactgctgggaggctctatttcatcttatgtaaactatagataatacctactcacctcaagggtgtatcaagggtttatgtaagctaaatttgtagaaagcagttagcacagtgccaggaaggatccaagaagaaatggtacttactatgatatatttgtacatatatatgtatgaatgttaatgagctcttattagctgtgttcattaaaggttttctccatcctgtgatttgcttttagattttggaacacatttcattgtgcacattccatttgtattattaatatgacaacatttattactaatattattatcatcatcaattcaatcacatctactatatccctgataatgaccatgatccttttaataatcacaaaactctcttcccttcatcacggggtaaataacctaccacaatgctgtaagtctccatcagcaccccaggctgcccctgctcacttaccagatctgctactttagccagatcaatcatcatgttaatgtcacacccacattcaataatggtgagtctgcgctttttacctataagtgaaaagatgaaaattttactttaaaaagaccctgaaaaaactctaaccatcaactcttaattttcattttttaattgcatccagtaaaacaccacatacgtttacaggagtgtaccagaagttcatttttataggcaaaaactggtaaaataaattccatcctgtttttcttcctgtgttctaaatttagataatatcaaaagcctacccagatgaataaaagtgctcaaaacagggaaaattctgactagacaggctccacgataaccatgatcttgctgttcagctgcaggccaatgtcttcacctctatcaaaatttcctgtattcccactatcgctaaaaacatcctcaaacataatgcaacagaatatttacaatgataattatttctaaattaaggtaataagaaaatgatcaagaaaatattggctgggcacagtggctcatgcctgtagtcctggcaccttgggagaccagggcaggtggatcccttgagcccaggagttttgagatcagcctgggccacatggggaaatcccatctctacaaaaacataaaaattaaaaaaaaggaaaaaaaagaaaaattagccaggcatggtggcatacactactcaggaggctaaggtaggaggattgcttgagcctgggaggttgaggctgcagtgagctgtaatcacaccactgcattccagcctgtgccacagagcaagactctgtctcaaaaaaaggaaaataaaatatggatgcgccaaagataaagaaaagcctcaatccaactatattactgcaataataagagatttcagagtgtacattgccattctaccactggacgtttgtttcatcttccctcaaacttggaaaggtcaccatctcccaaagcagacaaattctcataggaaaaagagaaaacgcgcacttccaccagcatgtggcttcataagggcaagcatgtgcacctggcacataggaggtacgtgctgtctgttaaatggtgtgttcgcagtgaccaggcctgtcaggcccttccaaggaacatgcttggcaaagccatagagcagtcaggataaggtatgtatcacatccttatctctgggaacttatccttttatgaagttatagctaacttagtaaaagtaagagagaggtaacatgatatgacaatatttaacatgttccactcaagaaaacaacaaacacacgcatgtccctcagatgacaacagccacgccaagtctgtgtctgtggcaccatctcctacctgacacgatcgtcacagggcctctgatctcggtgaacttctgccaggtgaagttccgaatgaggcattatatcaaagtgctctttccaactttggaggccccgtcaccactaccggtattggtggcggctctagtggagttccatcaaccactggaatatgatgcttttgtgtcttcaaatccagagtcctatttatttaaaaaagaaaaaaaaagtaaactcacttttaaaatagagtaaaaggtatcaaccttataagtagacttttttttagtataattacagatatgagtactttagtatattttatagagagtacaacagacaatataaaaatataagtaacttgtcaattattaacttctgacccctatccaaatcaattgctgttcaataaagatgtaacaagatgacttcaatagtatagagttgaaaattaaacacaccttaaatctgactgctttatgagtgatttttatagttttttaaaaaccaaaaggtaaatactgaggcagtgcatcataacagataagagcagaggctctggagttaaatttggctctccgacttactggttgtatgattggaggtaacttgttttcttgacctcagttttcttgtccataaaatgagggcaagaatgattcctactctggtaaggctgctggaaggatttagttgaataacgtttaaagtacactgctaagaatatcataaggactcactaaataaagctatgttagtattacatattgtaatttttgtattttatattacaactttgtaaaacatatccagagggaaaaagcacacttatcaccatagaaacagtttaaagtttaggaagaatcaaattctataaattcttgtatcttgggcaagaaacgccaaccagtgtgcagatgctggaggcaaggcagcttctatggcaagtcttctcacgttttagtaaaagccacacagcatgcatctccatgtcctttggagctggactagacttgtgaatccaaatgtcacctgtgagaggctcctaactatttaaaaagattcaatggaagaaccatcagactgtagctaaacacacctgtgaaaggatcgagacatccacacagcagactgaactgcaaaagcattggcatttctcttctgggcattttcttagtctcctagctggagatcctgcagatgccacttctttttctttgcagctttgggtccaccgtttttctttctgtgtttcttctggtccttagtctccatagtggctatttaccaataacaagtaactctaacctacaaggaagaaggttggggtaaggaggtgggagaagcattttacaatccaggcaatacccagggaaaaacattaaatttcatttatttctttatgaagacatgatgtatttgttcactgaacaagggtagaaactgcttaaccatccccaatttcatttctctctgttatgctataaattagatgagttacctctgctaaggttacattctatggttaagttactttttattcatctcaagtgtcaacatcaccagtacctatttctgcaaggatggaaatattctatatctgtacttttcagccatttagccattagccacatgtggttacttaaaatgtacttcagagaaactgaaaaaatgaattcttaattaatttcattctaactctaaatagtcacatgtggctaccatactggacagctcagacctagacatcgactggactaacgaagtggtttcctaacttaaaccagaacttaaatttcaataaaaaatttaaaacgtttttatgaacttccaataggatcgcagtattacttttagtacctgttgactctaaaacttctaaattacagctcatctacatacatttgaaaaatagcaatatctgtatgtgtgagatatgactggttttagatgatgcctggagaccccatggacttacagagacccttccagtgatttctgaggtacctgggaatctgtggccaataaattggtagtcactgaatctgtgagtttttttggaatatcgggctgcataaaatctgacagcttgattgagaaaaagcggggcagggtaccatttcattcagttaaggtcctgtattcattccgtttaataaatgtttgtgtctgtctatgatgtgctagccactgtgccagaaaatggatatagctatggtctgattggcagaggaaatccaaactagtatcttccgtgccatgcaataagggctacattgcaaggctgcagagggtgctactggagcacagaagtgagtcagaggcttctcacagacacacacacgagcggaaacagaaagtctttatatatcaccatatgtcaaggaacactggccgggagttaggagagctgggcactaggaacgctttgaaactgaatagctgtgtgatttcagaggttatattgcttctctactatattttactgccgaacttgtactgtttctctcccttttcttcttggtgggaaaagcacaatttggggtcaacagattcggctcaggtctaagtcgcctgccgggaccacgtcgccaggaaacgacgtctccccgacaccttccctcccagtccgggctctctgcagggattcatcccgtcactctcccaacgacccccgggcacacctcaggcagatgcgaaatatgccgctcctcgggagcaaagatgacccggaggaccgggggaggaccttcccatgcgcacgactcgcgatcttcccagtgccccagagccacggacccaaccgccgcctaccccagcccgcggcaccaaacctgttcacaactgcgactccttaggtccgcttggacaccgccggaaacggaaattcaccctcgcgccgactcgccggagggaaacaaaaaggcagaaaaaaagggaccgccgcctggatgactttcaggggacagctggaagaaagactcgtcaacggccgagtgctggcgccggcgccgtctgcgcagtgcgttccaccgggtccgcgtccctcccgattcagccccaccccgccctcggaatccgctgcctcagctcctgctgtggcactccccagcagcttgcacctcgctcgcggagtccttgctgaaggccagggcagctgtgcggcctggcgcgggttacttgatgccgtgcaaaagccaggagacacatttggttctggccgccccggagtcaccgtgcccggggcgaatggactatggctggattgggagtccacttcctcctctgtaaagatgacagacgagggagatctcgcgttctgggggtgccctatagccctcttttggccagaagcggtggatcacgcctgtaatcccagccttttgggaggccgaggcaggaggattgcttgagcccaggagttcaagaccaatctgggcaacatagggaggctacatctctcaaaaaataaataaataaataaataaataaataaataaataaataaataaataaataaaaataaagccagcgtcgtggcagggcgcctgtggtccctgtggtcccagctactctggaggctgaggcgggacgatcgcttgagcctgggaggcagaagttgtagtgagctgagatcgagccactgcactccagcctgggcgacagagcaagacactgtctcaaagaaaaataaataaataaaataaggccctctttttccgggaccaacagactctgagggcagggacaaactgacccagcctaaactgcctcgccttccctgctcccgggaaaggggctttccctgagggaaggtagcatcttgccattttcttcctgcacagctttgccttcccagggatccacccattgccacctgaggaaatgccttggagcccatctaatccccagcccagctacttgggacgcctacagagactacattgtcagaggatgcatcttcctctagtcttggagggtttcttttcaatatgatcccaccggtgcatgcaaggctcaattctacatcaaaaaactaggcccactcctgtcaccgagacccccaggcttcaggtcctgtcacagtgaccttgttatcacccccagcagcccccaggtattcactctgcataggctatatactgggtgctgcactagggaggctacctacgtggcgcatgcttcccttatccctgaagagcttaggatgttgtaacttcttcacactaggcctcttacttcttggagatgtcagtagccgggtaaataatctttctaacatccttttggtctcatgaagcccattcttgtcctctgccctacctcagcttccccctccctccatgatcagaccttagaccttgtcaggtccaaggactgcaaccctcacagtatcccactctgaccaccacctcctatctagagcaatggagagactttgtaggtgaaagctgtctttgctactggttctcctatgctccctcgcctggctcctgcaggcggttgacttcaccagggacacagtggccagtgcccagcaggtcccactcctctcaccagctccaggcagttttattatagagtaactcttctgagacaccgctcctttccccagcacctaaggaagtatttctagtaagttccagtggtatagcatcggtgactctcctgacaagcagagggccatggctgggttcctctgatgaggtgcaggggcagggcactaagaggggaggactctcctgagttctctacctgagccctagactagtagctgctcctcctatacttcctactagtctgtgcctggttactccacttccctgttgcaattaacaattccctaggtacacttttcctgttcaaatgactgtgtggcttctctttcctaatcggactctgaccaatacgctatcatttgccaacaactcccaaagttttatcagtgactcagacctctaacctgaactccagctgcctccatgacatatccatttggatgtttaatggacatttccaaagtgatatgccctacagaactcagaatcttccctctcaaaccaactgctcagcagtcttatgatcttagttgatggcaattcagaagtgaattgcaggacacccggtttgtatctgcagagagaactggagaactgcttagtgtggaaaacccacacatttggtttcagaagtgtgtgagtagaaacagttttccttttatgtttgttggatggataatgatgaacctagcaggacacagaaagctaggcagcagtggaactgagaatgaagttatacttaatagcagagaatgaaaaagaaaagacagataaaacattttgaagaaaggacagtaatgtattcccaacaggtaggatttacaggatggagagaagaggcaaagataactacaaaatttctagcctgagagactggtagaaaaaaaatggtggtatcagggacagacaggggttattaagaaaaaggattggatttttaaaataaagaagatctggtgtaaaattatcctcaggaaaactggaaaactaggcatgtacttctctccatcatgcccttgcacagtgcagtccttctgcctgtccatgcctcgcctccccctccctaggattcctcttcctctcttaagacccatctcaaatatcacctagacttgtaagtaatttacatgaaactggatacctgaggtttcaagcctttatccctttgaaagtttttaataacaagttactgttatcttttactaagtccaagtttatattcgccattttaactagcatcatttccgtttccaagaggtatttggtgtgaaagtgcaactaagtttactgttaatcaagatcagaataaaagaatctaccaaaaaaattaacaagatcccccttttaatgcataatcttccatccatcaggctgtaagttaaatacctaacataaaagaaagctgtatgttttatggatatgtacatatataactgcagggaatatgatttggaaggatatacacttagagaagactggggtcacaagtggtagtcaagggagtcttcagctttctttttgtatttcaattttgacagaaatacatacatatgtattataattttaaatttttaatgaaaaaaagtatttttccttttttttcttgatctgtcactacattatatttttccaatatcagctaaacatttgcttcccagaaagcttagttgtcttttcaaaatttattcaggttaaaataaaagatttagacaatgaattaaaaatctaagatggtatttgcctactttatacagaacagtacattgatgctgctaaagcaattaaagtataatttttattttctttctttttttttttttttttttttgagatggagtctcactctgtcacccaggctgaagtgcagtggtgcaatctcagctcattgcaacctctgtctcctgggttcaagcaattctcctgcctcagcctccccagtagctgggattacaggcgtgcaccaccacgcccagctaatttttttgtatgtttagtagagacagggtttcaccatgttggccaggctggtctcgaactcctgacctcaaatgatctgcccgcctcagcctcccaaagtgctgggattacaggcatgagccaccacacccagcctaaagtgtgtactttttcttagctcctatatgcagtgctccttccccatgctgaatgtctgaatttttatctgagacatagtatttcagatggtcattacttacgggtggtcattaatagttcctccctgcttctaaccttcctctcctcattttaaattaagttacgctacattattgtggattagaaagtacattaatattaagtgaaaaaatatgatctgatgagtaagtggcaagagtgttaacgtatgaatattaagagttgttctgaggcctttttgcttttctgggggttctgtgcttgtggtagaactcttggttattttataaatagttgctgaaaagtgagagagtacagctggaaatcagatttctgatgaataaatcaaaccctattaagagaaccaggttgaagtaattttaaaaccatttggattttcataaatgttttgttaatgattaattataaaaaaaaaacagtgactctagctggaggcttttgtgtgtttgcttttgagtcagctaggaaaaggaagaaaaattcaagcttagtcaattgtggttttcactgaatcttttttaaagtaatgagctggtttgttttcttcatcactgtagcaacttaagctagtttctgcttttgatttttatttctcctagagaaacttagcatgcactgctcattagacttgagcatactaaggaatatctgtggtaattaagttaaaaatcagatcagtgctttgtgctgtgtatagttgcagatgtctgcatttcactaatattctttggaaacatctggataccagttaacataaaataactgtttagttggtttctgttcagaatagaaggaatgatttaaaagttcccattgtagtacatacgtcattctgtccctagcccttcctccagctttactgagatagataaataataaacgtcatgggtggtgtgtcttcagtttcctctggtgagctggatgcacagattactttgtcagcagggtggccttgatttttaggccatgtgtctaatggcatcagctctgtggccgacacctgtgtaccgagcccattcactatctagcttagccagccgtggactcctgctctttgttaaaagtatttaccttcattcctactagcacagttgaccaaagactcagttgatcccagacactagtaatgcatcaatggagtctaacagggttttaagatgtgtgtgtgtgtgtgtgtgtgtgtgtgtgtgtgtgtagaaatgggatctcactattgttgtccaggctggtcttgcacacctgagctcaagttctcctgcctcagcctcccaatgtgctaggactacaggcatgagccaccatgcctaaccctctaagactttgggatacaaaaatataatttactttcctccatttctggaataaaacatctcttccttcctccccctagtttctgttctgtgcccctgtttgatctctgttggtcctgttcaccttcagccttctctgctgaaggaggaaaggcttggttttataaaaagtgacaatattcagaccacataagatccttcttgcttcattttggattaaatattttaagattttctgattttcttgtatgcatatgtatttacctattatttgactttattgaataacttcaaattgagtatatttgaatgggaatgggcattaaaaagggctaagctttccctgcctttcagaactttgtatgtatatgtcacatcattttgtccttcacattctccagttgtgctattttttcccaatccattaagtagagtaacttcctttttggagtcttactttttttttttttttttttttttttttgaggcggagtctcaaaccgtcgcccaggctggaatgcagtagtgcaatctcagctcactgtaaccaccgccttagcctcatgagtagctaggaaatacagaagcatgccaccacacccagctaatttttgtattcttagtaaagatgggggtttcaccatgttggccaagctggtctcgaactcctgacctcaagtgatctgcccagctcggcctcccaaagtgctgggattataggcgtgagccaccacatccagcctccttacttaaatctcttaatgtgccttagaatgtagttaagaattttcaggtgacagtatatttttgatagttatctttggtttccaaacccagagaaggaagagtaactggctttttctgtttgtgggtacattgtgtcttattggagattgttttgtctcaagtattgccgcagagtattttattaatgggtgcactttaaaattttttgtttttcagattaacagtttaggtagcccagtactcggtatttgccaatttctagaattaaaaacgtgtgtatcactggttaactagaaatttaaaatgaaaatgtgtcttctttagcccaggcaatatcacttgcattcacttctatcccctccttgtccctactctgttggctccagggcttcttccactaagctggtactttctttatagctcctcctgtacttccattcactgaacctttattggttcatagcctacagaaaatgcctgtggtgtgagaggtaatttgtgaaactgcttctcttcactgtttagcaggttgagctctctaaatgggtgtagctgggaaagaaaatttaactttacaaacaagaattcctgggttccatccagcggaacatgtctcttgttatacacacacagtttctgacccatatcattccatgacttatgataaaatggacattctgtttacactgttgtgtggaaggagaggtctggttcctaatttttagtaacatctatttctagaatattaggcttgccatttgaatgcttctgtttgatttatgaatatcattggttccagcagtttttagctccctgctaaatgcaagttaaaatttttaagtttctaagttaaaagaaaataacttttcctccacttaagaaagccaggaaaattaaaaataatgtagtgatgacttccacaggctctaaaagagcaatgaaaaaagtgatttatgtgtgggagaagaaatactagttcttaattaatacattgttttaccacttcccgtgaatttatgtagaagtaatgaaaccaaggtttaagtcatttgttcaaactcctgtcagtttagactttttaattgctttgttacatgccattgctttgtaatacttgttatagcagtggtaacagttgagatttgcctgtttgaccacttgcagggcaccgtgccagattccccatgtgcgatgttcctcgcagttgtgacgcccatcctaggagggtggcgttagcacccctccatgcaagcggatggtgcaggctgggtcacctgggcacagcgcctgactattttcctggcttagtgtagttatcattaaatatgtggtattacttagaagcattttgaataatttgaaaagcacattttagtgttaaaacaatttttttttttgagaaaaggtctggctctgttgctggggtggagtgcagtgacctgagcgtagctcactgcagcctgcaactcctgggctcaagcgattctcctgccccagcctcctgagcatctgggactacgggcacatgcccccacacccaactcaattttttttaagatacaaaggattcatcttaatattatttacaatttttttttccttttctgtgggcctcatctgactggaaagcctttcaatttttttattttttaaattgtaaattgacaaattgtagatatatatttatgaggtacaaagtaattttatgatttatgaatacaacattacataattaagtcaagctgattaacctgttcactactggaaacaattgcaaataattatcattttttctggtgagaacatctgaaatttactcagtgattttgaaatgtgcagtactttttgttgttgttgtagaaatgaggtctcactatgttggccaggctggtttcaaactcctgagctcaagtgatcctcccacctcagccttccagtgttgggattacaagcgtgaactaccatgttgggccaaatgtgtaatctattattatttactgtattcaccatgctgtgcaatttatctcaaagaaacttattcctcctgtctaattgaggctttgtgccctttgaccatcatctccccatcacccccatccccaatgttgtatactgagtcctttcatgatatgtatggaggcttatggtaagttatttaaaagtacatgtatgtcaaaattttttgtggccatagcttttctttcttttttaaattttaagagtcagaatattcgtatattaattcagcatgtatttgagtgcctaatgtatgccattttctatgttaggaaccaggaattaaagcagtgaacataacaaagtctgccctcgtggtgctaacttgccaggtagggaagccagatactaaacacatgtataatgcaaagtcagtaataataaacgatatgaagaaacaagtaaggtaggagaggcaggaaagtgggagtgagaaagaggtgctcttttaaatacagtggtcagggagagcctctcagaatgaagtttttaacagagacctgaatgagatgggggagtcagctatacagatatctgctgtgtgctagaaaaattacctgtaattttgcattctaaaagtttaatgagtacatttatttcacaatttgagaatcaattatgtataagatatagttgtaagcacatactcctctaaatatgatttgtttttacagtagaccaaataagtatgttcagcttagaatatgctctttatgatctgtataataaatacattctcttaaaatattgttaatattaaggttgatgttttcagaaacatataaaaaagctagcttttaaaattgactagggaagttctctcaaactgccagtccctgagatattgtatattttctatctgaaaaacttttattctcagaattctttaaaagagctgtccctgaggctcccattacttacctgtgactcccagtggaaatcgtacccagcccctcgagaggggctgaatctgttgagagtgggagggtagaaaaaatgctgcagcttcttgtgggtaaacttcacacacaaacacccagtgtcccaagcactgtgcagtcaaacatcaaccctgctcagactttcctccttgggattgagaagcaatggattatagagaaagaaaggtggcttagcactccaaaacttggaagggtaattgaccaagaccccccaaagccaaagcagtgggcatccccactttctgtataccctataccaacacgtaatggctactagatacaggggcactagtacctgtctgcttggctacctccccttcttgcagaagtggtgaagggaatcactcaacctcaggaagggaaaatggctttctcatcttcaaattgaaagaggttggcagtgggtgaggagaataacaggtaaggatctctttcaatatacccatttgaagccaaaacctcagtttagacatacggtattttgaacctggtgactattcattgcccatgtttgtgaattatcagaaagcagaattcttgccaggcatagcggctcatccctgtaatcccagcactttgggaagccaaggtgggaggatcacttgagcccaggagtttgagaccagcctgggcaacatggtgagatcttgactctacaaaaaattcaaacattagctgggcatggtggcatgcacttgtggtcccagctactcaggaggctgaggtgggaggattacctgagcccaggaggttgaagctacagtaagcagtgtctgtgccactacgctcagcctgagcaacagagcaagaccctgtttcccacccctacccaccccctaaaaaagcaagctgaattcttgaactccctgcaaccaggtcacgcaaaccaaaggtaaaaggaacataaaaaagccttctggaaagtgtacagaaattcattgcagggtgatttttgtcttgtgaaatcatagttactgttattagcagctttttaaaatgttttatattcattttttatggtgttctgatgtatgagctgcttcaagtgcttttggacatagcttgggtataaaatgtaaaaagtggatattttcaatttgtagctttcttttttgaaacttattgaaatttgttctaaatataaccccttctttctcacccaccccaacacattttttaaaaaacaccaccaggtatccgttatagcactgatgtgagtgtagatgaagtaaaagctttggcttctctgatgacatacaagtgtgcagtggttggtaggtgatcgcttttcttgctacctaatgagaactctggggaaatatgtttacaaacatgttactgttaagatgctatagaaatataccttatcggaactgatttttttttaagttgtactctttaagacctgcatcatttctcaattactctaaattaagatatagcctttttttacgggagggatttttttacgggagggagctaattggattttaagtctagatctttgttttcaattcctcaacatattctataaataagaccaaattatagtagaaggagagtaaataagctattatctttttaaagtggtgaagagcactgattaaatatatattagagccccagcccccgccccagctgcgcgggcccccgcctggcccatggactgcacagccgagcgggcgccttgagcgcggtgcgggtcctcggagcacccccgaggtgagcgcaagcaaggtccggcatcatgtgctaggttattcccagtgcgaggccacacttgggccgtcggagcagcccctcctcacttcaggggtcaccctccccaagacccattgccccatcatggccggggaccggctccccaggaaggtgatggacgccaagaagctggccagcctgctgcggggcgggcctgggggggcctggtcatcgacagtcactccttcctggagtacaacagctggcatgtgctcagctccgtcaacatctgctgctccaagctggtgaagtggcggttgcagaagggcaaggtgaccattgtggagttcatccagccggccgcacgcagccaggtggaggccactgagccacaggacgtggtggtctatgaccagagcacgcggccgcagacagcttcctctccatcctgctgagcaagctggatggctgcttccacagcgtggccggctgcttccacagcatggccatcatcacggggggcttcgccaccttctcctcctgcttccccgacctctgcgagggcgagcctgctgccctgctacccatgagcctctcccagtcctgcctgctcgtgcccagcgtgggcctgaccctcatcctgcctcacctctacctgggctcgcaggaagacgtcctgaacaaggatctgatgacgcagaatggaataagctacgtcctctatgccagcaactcctgccccaagcctgacttcatctaccagagccacttcttgcgggtccccatcaacgacaactactgtgaaaagctgctgccctggctggacaagtccatcgagttcgtcgataaagccaagctgtccagctgccaagtcatcgtccaccgtctggccggcatctcctgctgtgccactatcgccatcgcctacatcatgaagaccatgggcatgtcctccgaagacgcctacaggtttgtgaaggaccagcgcccgtccatctcgcccaacttcaacttcctgggccagctgctggaggaccagagcagcccgaagctgctggccgccgtgcagggcgacgcgggcaccccctcaggaatgcaggagcctccccccagccctgcggccggggccccactgccatggctgccaccacctacctcagagaccgctgccaccaggagtgcggctgccagggagggcggcccgagcgcgggcaggaagcccccggcgccccccacggccaccagcacgctgcagcagggcctgcgcagcctgcgcctctcctcggaccacctgcaggacaccagccgcctcaagccctccttctctctggacatcaagtcggcctacgcccccagcaggcggcccggcggcccgggcccagcgaccccggcgaggccccgaagctctctgaaagctggacagccagtcggggccatgttgggcctgccctcgccctgcccggacgccgcgcccaggcacgcccacggcccggcgcgctaccccgcgcgcggcctgaacttcggctacgcggctgccgggccctggccagccggccagccccggagcctggacgccaccgctcgactccctgaagcgtcctcggtgcttcagccccgagggcgtgcaagggccgggcagggtgctgtttgcgcccttcggccgggcgggcgccccggaacccaacggctgcagcgacctgccacggcgggaggcagcaagggctgagcccgggacgcgcggaccagctggtcagacgagctggccccggattcgcacttcaagtgctgcagctgccagatggagttcgaggagggcatggtggaggggcgcgcgcgcggcgaggagctggccgccctgggcaagcaggggagcttctcgggcagcgtggaggtcatcgagatgtcctgacccctccgctgccctcggctccgccgcccgcagctgggcagttataaatatatattatatataatgcaaagaaaggcaaatggttttactgcgatttttatccagaagtaaatatttcgattttttatttatttaagctgttcattctggcactgatttggcaacagtgcgggtggtcctcgagctctatttttactgtctggtatttaaaccgaaacacacgtttctaagcaataagaggccaccttcagtcgcaagttgcaggccaggcctggggcccctccctgatcccccgccccaggaaacactgctgacatttgcagaggctgccgagctttcgtgaactttttacacaagagaaagttgaaaaaaaaaaaaaactttcttgccacaaactgagccgcagaaacccccttcttcccccacccaccgcccctgctctctcccttcgggctccgccccaaagccataggctgggggagcaggacctggtgtgccccagagaggtgcggccagccctccaccagctctaggcaccaaatcttggtggcagggagggcaccccgctgcccgttgccccagagctgttccctctcaggggaggacatgcattgggccccatggtgccagggcgttgagaggggctgaggaatagaacagtgtgtgtaggggcttggggcagggggttctggagggtcagatgaggcagagcccaggggaggatgggggtgttattaatgccccaactcctgccagagccccagtccagccactgagtgcctcagaaaggccattcccagagggctgcggccctcccttctcctttgcccctgcccccagagctacctgactggcagggcggcactactgcaggagaggagcttggcctccgggggtcaggcaggaggggggcctggctagcctgtgctggctccactgggcggggagccctggactgccaggtatgaggagggggtgggcttagggtcctgttccaggtccgtcccccacctagcaaggccccaggcaggacttggaaaccaggtgtgcacctgcaggctgaggggctccatgagcaggtgctgccttgcacagggagttcaggcgccagccaagcccctgtgcttctggggtaggcctgcttcacttagggagcgctgcctcaaggcagataaagcccccttgttgacccgacctgcatgggggcctctcaggagagaaactctcgtgcgcccctttcccagggcgccctctttctagacagcattccagcccccaaacacaggtggcttttgggcccagatgggtcagcctgctgctcctggcccataccctctcaggccgttgggactcctgcccttcagatgtcctagggtctaggagtgggccagtcaccctgggaagaggccaggggcttggcaggaggggcggcccaggcgggacccagtcctgagtcctggagcagggccagggaggcgcccgccccaccccagccagccgccttctctgctgtttcttctatttgttcttcttttcacccacagccctgtgttcctgtcatccctcctttcagcaaaagtcctgttcccgttccctctgtccccacccactcttgttccccaagaaaataagctatcattgttgcatttgcaatctatggattagaggtttaagtatttattattattggttaattattattatgttttatatatatatattagaacttggctagccaattttattgaacaattcctgttcaataaatgttgtttaaagtacagttgagaaaacgatggtaggtttatttcttgaactttcagaagttcaagcttaaagcatcacacgtttttctaatatcgtgtggcgctttctgtcattttacttttttaacctttatatggaatagcaaccatcaaccttctctttcagatgtgccgtttgggggtgctaaagctggtgttaagatctatcccaagaactataccgtaagtatgaaagtttttgtttttgtttttgtttttgcttttttgacacagagtcttgctctgtcgcccaggctggagtgcaacggtgcgatctcggctcactgcaacctccgcctcctgggttcaggcgattctccttgatccagtaactgggattacaggtgcatgccaccatgcctgactaatttttgtatttttagtagagaggggatttcaccatgttggccaggctggtcttgaactactgaccgcaggtgatctgcccaccttggcctcccagagtgctgggattacaggcatgagccaccgcacccggcctcaaagtgatatttgtgcacacagtgcatttatgaaggacttgaaattactgggcttctctgtatcccccatatcagtgaaatcaatagtccccattgcttttcaaatggaatgaaaaaagtaaagaattaactcattgagtgttttgccatataaaggtcacctacttaatatctatatcctttatcattttctgttttgtttggttttgtttttatgagtcttttttttttttttttttgctttttgtattattattttcttatttaaaaggtaattaatatcttcatattattagacacctatacccatatttaagaagtactgtgatctggctgggtgcggtggctcacgcctgtaatcccagcactttgggaggccaaggcaggcggatcacgaggtcaggagatcgagaccatcctggttaacacagtgaaaccccgtctctactaaaaatacgaaaaattagtccggcgtgttggtgggtgcctgtagtcccagctactcaggagactgaggcaggagaatggagtaaacccgggaggtggagtttgcagtgagccgagatcatgccactgcactccagcctgggtgacagagcgagactttgtctcaaaaaaaaaaaaaaaaagaatcactgtgatctaattagccaggcatagtgacgcacacctgtaatcccagctactcgggaggctcaggcatgagaactgcttgaacccaggaggcagaggttgcagtgagacgagatttcaccactgtattccagcctgggcaacagagcaagactctgtctcaaaaagaaagaagaaaagtagtactgtgatctgaagtttttaggtcaggatctcatgctagtgacaaatatcttaactaagccaataaaaaccttactttttatcctgtcagttccaagtaaattcaaactggttgtcacaatgctttacataatactaaattatctatatacaaacataaacagatatgatttttattctctttaaaattcaccatttagatggaatataattatattacagttaaccttaattaagatttggtatatttttcagtggggaattaatagaatgggaatttgagtcctggttctactatcttgtttttataacctacttttttgatcccttattttctcacctttaaaatggcattgcctaccttatgagttgttctaaggatgagaagacatgaaaatgtactataaatagaaaataagatgctagctataatctcaagcgatttttatatcttttttatttttattgttttcttattttacaggataacgaattggaaaagatcacaaggaggttcaccatggagctagcaaagaagggctttattggtatgtgtagccacatagattttggcataaagtgggaacatctaaaaaaatcttttttttttttttttttttttgttttgttttgttttgtttttgagacagagtcttactctgtctcccagactggagtgcagtggtgcaatctcctccacctcccgggttcaagcaattctcttgtctcagcctcccaagtagctgagactacaggcatgtgccaccacacccagctaattttcgtatttttagtagagatggggtttcgccatgttggtcaggctggtcttgaactcctgacctcgggtgatccacccatcccagactcccaaagagctgggattacaggcatgaaccactatgcccggcctcctactatttgtgataggagcttttgccaaacatacaacatttttgaagacactaatcttcgtttgcttgatgtcttcgtatcttactattatctgtgtttatatgttctttgtgtgtgatctgaacattcttttctatgatatgtaaatatttgtcatttaccttctaattttcaggcagtttaaacctttctatacatatatttttaatctagaaggcttctaatttgtttgaatagaatacacataattatttaataaaatgcttgccctatcagtatagttaatagaatgttaatagttaataatataatacttgccctatcagtatcagtatagttaaacaaaataaggtctacttaaataggaaataaagtgtatttttctctactttctttctcagcatttcccccaccatggacaaatgcctatgaaattaaactataaagtctgggcatggtggctggtgcttgtaatcccagcatttttggaggttttggaggctgaggtgggaggatcacttgagcccggaagttcaagaccaccctaggcaatatagcgagaccccgtctctacaaataatgaaaatgttatccaagcgtgatggtgcatggctgtggtcccaactactaagatgggaggatcccttaagcctgggaggttgaggctaccatgagctgtgatcatgccactgcactctggcctaagtgacaaaacaagaccacatctcaagaagaaagagaaaagaaataaagctattcagattcatttttaggaaaaaagtcatgaaataaatgtcatgaaataacctaatatagaaatacagtaagtataggtaactctaaaacttgactagatttggcctgtctttcataataaaaggcatttgggcctttgacgtgccgcatacccagcactactgtgaatttgtgcatcattacgaggagcctattaacatgagtgaactatctcactcacacttttataggagtacctaccgattctgagatatggtgaattgaagtcatgttcagcctgttaatagccttcataattttcaaaaggtctttcctcctcgcctaaatctcaaacacattttatagtcttgaatggtttcagactttattcagtcatatttatcgcccatatctgcaatatctccagctaaattttatcagtcttgacaagtacctaataattccaaaggtcaaaaagtgattcattggaatactgaaagaaaacacagcttaaactctagtaacttgatttatttgcctaattcgcaaaggcctcattgacccatgatgcagctaaattgacgtcttggcccagacagctttgaagcctaggaggcaggcaaagggagttttttctctcacttctcggcaaaccttcaaattcgatgctatttatctgttatttcctgacactccacagagagtgtcagattgaggctcagacctgagcctgagccctgatcctatcacatgtgtgtttagcatcagcttgtaaatttctacaaaacaaaacaaaacaaaaaaaaagaggctgggattttgataggaattgcattgaatctgcacaccaatttgtggagtattgccatcttccccaccctccccaaaagggttttgccctttcacccaggctggagtaccaggcagcagtcactgcaaccttgacctcctgggctcaagcaatcctctcacctcaccctcccaagtagctagaaccataggcgtgcgcaactgcacctggctaactttttaattttttgtagagacatggtctcatcacgtatcccagactggtctcgaactcctggaatcaagcaatcttcccacctcagcttcccaaaattctgggattatgggcatgagccactgcacctgaccagtattgccatctcaaccatattaagccttccaatgctgaatatgagatgtctttccatttatttaggtctctgatttctttcaatgatgttttgtagttctcattgtagaagtcttacaactaagtattgtattccttttaatgctattctaagtgacactgatctatcgttttcttatgatgtctttgtctagtctttgtatccagacaattctagcctcatggaatgagttgaggagtgttccttcctcttctgtttttggaaaagcttttgaaaggtcggtgttcattcccttgtgtgagtgtaaatatcacctatgtaaagttctgcaggaccctgatgtctccacccttctcatcctcttatatctctgtgcaccaaaattaccctttcatctcctactctatagtcacatgctgttagaaaagttgcttttttaaaaaagatgaacttctgcctcagaccgtgctctctatataagaatttacctgttaggccagtcgcggtagctcatgcctgtaatcctagcactttgggaggccgaggcaggcaaatcacctaaagtcaggagttcgagaccagcctggccaacatggtgaaaccccgtctccactaaaaatagaaaaaagtagccaggcgtggtggcgggcacctgtaatcccagctactcaggaggctaagggaggagaattgcttgaacctggaaggcagaggttgcagtgagctgacgtcatgccgttgtactccagcctgggcaacaagagtgaaactccgtctcaaaaaaataaaaattaaaaaaaaaagaagaacgtatctgttattcaggagctacttgtaatctgtgcatcccaatacattagttttgtatggagcagaaaactagtaagcctaataattgataccttgtgattttgttttgggtgggtgaagctgtttcatgtttaacatgtatagactgtttttgagaaggattttatcattatatgtttgtgatttacaaactgtgtgcttcagacttgccacttgccagagcccttctccaattggaattgttttttgtttttgagacagtctcactctgtcgccaggctggtgcaccgtggcgtgatctcagctcactgcaacatctgcctctgaggttcaagcaattctcctgcctcagcctcccgaatagctggcactacaggcgcgtgccatcacgcccagctaatttttgtatttttagtctacaacagggtttcaccacgttggccaggatggtctcgatctcttgacctcgttatccacccaccttggcctcccaaagtgctgagattacaggcgtgagccaccgtgcccagccagcttttttgtttttaaaatatattgtttaatcaagatgggatctcactatgttgcccaggcttgtatcaaattcctgggctcgagccatcctcctgcctcagcctcccaaagtgctgggattacaggtgtaagccactgccccagcctagttggaattgttgtttgaggtaacaagcttacttaatcctaaagcaagcataatactttcgtagatgcctctagaaagattcgggaccaatttgtcatttgtacattgggagaaaaggagtggttaaacaaagttttactgacctccagcagaggtatgtcactaaaggaatggaaagtgagcaaacaggagctggagagcaccagagagcccttttgtcagtggatgaggctagaatatggcattaatccttccaagtgctgtgtggggttagacttctcatgaaggataggtttgggtaggttagacttcatgagatttttttctgtttttaagttttttgttgtccttgttgacttcatgagatttttaaggtgactaagggaagggtgctaagacatagagttacagattaggtgggaggtggagagggttggggtataaaaagcagtccttgaacatttcaaagttgtcttataccagccctgtatccaatatatcacatcttgttcaaagaagttgattatctaggccttgggcccctgagttaaagaaaaacattacagtatactgattccgtcgactaaaaagtaaaatttataggaagaattgagtacagtccttagaaagaactttaattattttatggggggacataatggtttaatagtttaacctcttttttttttttttttttttttttgagagacagagtctcgctttgtcgcccagactggagtgcactggcgcaatctcggctcactgcaacctccgcctccagggttcaagtgattctcctgcctcagcctcccgagtagctgggattacaggcacttgctatcatgcctggttaatttttgtatttttagtagagacggggtttcaccatttggtcaggctggtctcgaactcctgaccttgtgatccactctcagcctcctaaagtgctgggattacaggtgtgagccacaacatccagcctaatagtttaaccatttttaaagttgtgtttttctttttgtaaagatgagtttctattatacagttgaaataatatagaaagttataaacaatatatatatggtggggagaaagaatggggaagagaaagaaaattgtaagtgggaacatgttatacatgttgtatgaaacctgcctttttccatatgtatgtttgtgataattccaagtaatttacatgcatatgttatcctttttaatggctgtttagtactttgcataggtataccatagttcatttaattgacatacaagataattagattgtttttatttttactatgtttgagaggagtatttctgcacctttacggatttgagtgagcatcacttaacatgtttttatcagagatcttactgtagcagtcagtagtagtgcagtcagtgatttctgctatggcctgtaagctaatttgttagcctaacacttcaatttgctatgatctgaggaactgaaagctaaggcctaaaattttatatgtgctaagtgtcgaataataggtcaaagctgcattcttccacaagtaaagataatatggggcttaacacaattgctttagcaatgtgattttctcccctttttctctacttggtaaggagggcttatacccccactaagcaggcacatgcctgtaatcccagctactgaggaggctgaggcaggagaatcgcttgaacctgagaggcagaggttgcattgagctgagattgtgccattgcactccagcctgggcaacaagagtgaaactcaaaaaaaaaaaaaaaaagaaagaaagaaagcaagcaagaaagaaagaaggaaggaaggaaagaaagagagagaaagaaagaaaagtaaatctgtggatattgtacaaaagattgttttatgattttttaatttttttaacataacttttattgacttgtatttgtatttttatcaaacatacttcatttgtttatttatttattttgagatgaaatctcactctgtcacccaggctggagtgcagtggtgggatcttggctcactgcaacccctgccttccaggttcaagcaattctcctgcctcagcctcccacgtaactgggattacaggcatgagctaccatgcccaactaatttttttattattagtagagatggagtttcaccatgttggccaggctggtctcaaactcctgacctcaggtgatccacctgcctcagcctcccaaagtgttagtattataggcatgagccaccgcacccagcctcaaacatactttagacaatttttcacctcagcactattgacattttaggctatgtaattctttgttatgggggctctctctgccttgtaggatgtttagtaatatccctggcctctacatattagatgtcaggaagacccctcagttataacaatgacaaatatattcagattgccaaatgtcccctgtggagcaaattcatcccttgttgtgaactgtgatccagagagccaaatagtgatacaaggtttattgttcacaatagctcgtcccctccaatccagacatctgcctcaccatattccactccccagaggcaaccactttcaacaatcttaaatgtttcatttttattctatttaaagcctttgctcatttttaaattgggttttgtccacattattgagtggtaagagttctttatatactccacagccagttgtggtagtataggcctatggtcccagctactcagaaggctgaggcaggaggataacttgagcccagaaggtcaacactagtctaggcaacatagcatgaccctgtctctaaatgagtctttgaagtatatatattctaggtaattgacctttatcatgtatataatttgtaaatatttcctctcaatctattagttgtcattgcactttcttgatagtctcctttttaatcttgagaaagcataatttatttttcctctggttggtgtgctttaggttgtatgtaagaaaccattgcctaatccatagtcatgcagatacatccctatcttttttttttttttttttttgagatggtctcgctctgtcgtccagattggagtgcagtggtgtgatctcatggctcattgataactgcagcctctacctcctaggctcaagcaatcctcccccttcagcctcccaagtagctgggactatagcaccagctatagtcagcctcccaggtagctgggaatatggcaccaggactatagcacataccaccactaagcacagctaatttctgtattttttggagagacaaggtctcaccatgttgcccaggccagtcttgaactcccaggctcaaacaatcctcccacctcagcctcccaaagtgcaggattacaggtgtgagccactgtgcctggcctagagaggtttttttaagaaatagtgaccaaaaatatcccacatttgatgggaattgtgaatctacacattgaagatgctcaacaaattcaaagcaggataaactcaaagagatccacactgacacacattataatcaaattgtagaaagctaaagacagaaaagcagcaagagataagtgattcatcctgtacaagggatcttcagtaagactaacagttgcttatcagaaatcacggagtatagaaggcagtggtggtgtgctgggcatggtggcatgtacctgtagtcccagctgactgaggctgagacaggagaattgcttgagcctgggaggtggaagttgcagtgagctgagatggcgccattgcactcccgcctgggcgacagagcaagactccatctcaaaaaaaaaaaaaaaaacagggttggggaagctcagcatggtggctcatgcctgtaacttcagcacttttggagactgaagtgggatcacctgaggccaggagtccacaaccagcctgggcgacataaggagaccccatctctacaaaataaaaataattagccagacaaggtggctctggcctgtggtcctagctactcaggaggctgagacaggaggattgcttgcagccagcagtttaagactagcctggacaacatagtgagaccccgtctctacaaaatataaattaaaaaaattagctgggcatggtggtgtgcatctgtagttccaactactcatgaggctgagacaggaggatcgtttgagaccagaagttggaggttacagtgaggtatgatcataccactgcactccagcctggttgacagagcaagaacctgtcactaaaaaaataataaatgaataaaaatataagaatgcttggcctggtctgggcgtggtggctcacgcctgtaatcccagcactttgggaggccgaggcgggtggatcacctgaggtcgggagtttgagaccagcctggccaacatggagaaaccctgtctctactaaaaaaatacaaaattagccaggcatggtggcacatgcctgtaatcccagctactcgggaggctgaggcaggagaattgcttgaacctgggaggcagaggttgcagtaagccgaggtcacacccgattgcactccagcctgggcaaaaagagggaaactccacctcaaaaaaaaaaaaaaaaaaaaaagaatgcttggctgggcacagtggctcatgcctgtaatccctgcactttgggaggccgaggcaggtggatcacctgaggtcaggagttcgagaccagcctggccaatatggtgaaaccccatctctactaaaaatacaaaaattagctgtgtgtgatggcacgtgcctgtaattccagctacttgggaggctcaggcaggagaatcacttgaacccagaaggcagaggttgcagtgagcagagattgcgccactgcactgcagcctgggcaacagagcaagactcgggctaaaaaaaaaagctgaagtgagtccttcaggctaaaatgaaaagatacaagataataactcagagctatatgaaaaaataaaaatcactggtaaaggcaactatatagctaaatataaaagctagtattattgtattttgggtatgttattcctctttctcctttatgatttaaaaacatgcatgaaataatatgcatctatgttaataggaactaattgtttaaagacataatttgtaacaatatagctaggggacagagaaaggagcagagttaatgtatgctattgaagctgagttggtatcagtctgaactagacttagaactcagcatgttaactgaaatcttcatagtatccactaaaaacaaaactttaaaaatatacagaaaaggaactaagaaaggatcaaaatattacaggataaatcattaaccaaacacaaaagaaggtactgaggagcaaaacactttatgtagaaactaaacagcaggatgacataagtaagttctttggtgtgtgggtttttctgtttttcttttttggggtttctttgagacagagtcttgctctgtaactcaggctggagtgcagtgtttcattctcagctcactgcagcctttgcctcccaggttcaagtgattctcagcctcctgagtagctgggattgcaggcgcccaccaccagacccagctaattttttgtatttttagtagagatgaggtttcactacattggccaggctagtctcgagctcctggcctctagtgatccacccgcctcggcctcccaaagtgctgggtacagccatgagccactgcatccagcctgtttttggttttttttgagacagggtctggctctgttgcccaggctggagtgcagtggcacaatcacggctcactacaaccttgacctctgcaggctcagctgatcctcccacctcagcctcctgagtagctggaactacaggtgtgcaccaccatgcccagcttatttttctattttttgtagagacaggagtcttgctatgtcgcccagcctggtctcaaactcctgggctcaagcaatctgcccacctcagcatcccaaagtgataggattacaggcgtgagtccaaccataagtaagtttctgttttttgtttttgagtcaatctcactctgtcccccaggctgaagagcagtggtgcgatcatggctcactgcagcctcacctccaggcgggagccaccgtgcccggtcaagtaacttttctgtttcagtaatcactttcaatgtaaataatctcatcaatggaaagatcggcagaatcaatttttttaataatgtaatacataatccaaatatgcaactcacaaaatactcactgtagacccaaagacacaaatttgttgaaactgaaaagatggaaagagataatccatgcaaatagtaaccaaaagagagccagggtggctatactaataataccacacaaaatagattttaagccaaaaactgttacagaaaaacattttatgttcgtaagagagtcaaatcacaagaagatgtaacaattataaacacatatgaaccaaaaaaaaaagggctccaaaatgcacaaagcaaactaataaaattgaaggaagaaacaattttacaataatggagacctcaatgcagtggctctatcacagctcaccgcaatctctgcctcccagactcaagcaattctccagcctcagcctccccagtagctggaactataggcacacagcaccacacccagccaatttgtgtatttttttgtggagacggggtctcaccatgttgcccaggctggtctcaaatgcccaagctcaagcaattcacccacctcagcctcccaaagtgctgggattacaggcctgacctactgcgcccagtcaacaccccaccttcaacagtaaatagaacatctagacaaaatcaataaggaactagaggaattgaacaacacactaaaccaactagacctaacagacatatagaaagctctccatctaacaagtgcagaatatatattcctctcaagtgcatatggaacattccccatgataaatcatatgttaggtcacaaaacaattctcaatacattttaaaaggtcaaaattatatgaagggccacatgtgttggctcacagctgtaatcccagcacttagtgaggctgagacaggcggatcacttgaccccagaagttcaagaccaggctgggcaacatggtaaaaccctgtctctacgaaaaaaaaattttaaaattagctgggtgtagtggtggtgaatacctgtagccccagctactcaggaggctgaggcaggaggatggcttcagcttgggaggcagaggctgcagtgacccgagatcataccactacactccagcctgcaggacagagcaggacctgtctcaaaaaacaaaacaaaacaaaaaaaacaaaaacaaaacaaacaaaaaaaaacaggccaggcttggtggctcatgcctgtaatcccagcattttaggaggccgacgcaggtggatgacctgtggtcaggagctcaagaccagcctgaccaacgtggcaaaaccccatctctactaaaaatacaaaaaattagctggaaggggaggcaggcacctgtaaccccagctacttgggaggctgagccaggataatctcttgaatctgggagacagaggtttcagtgaggcgagatcacgccgctgcactcaaccttgagcaacagagtgaggctctgtctcaaaacaaacaaacaaaaaaattatacaaaaaaaaaaagtgaactgcatgttgctgcacagtctaccatagcacaaatgtcaattgcttcttggctttcctggggtgatgggaggtctgaacctaacacagtctcacctgatccttcacaggagtcacgtagcctttctctctccagtccacagatgtggggatctcaagaagcaggcgttcctggaactgtttcccgttcctgtgcttctggtattgaaaaccattcatcacctgcctgaattcttcagtggtcttcaaagaaaagtaaataaaatgttaagaagcaagagattaatttggtaaagaactgaggaggggaagcacagagctgggcagcccacagcatacttaccatgtctccaaaggtgttcatggccattgtgaagctgtgtttcccttggctgtattcctgattgtgctgctcagtcatcttcatgttctctcacactgctctcctccatccttcttcattctaaaggcaaacatgtaactgatgttcttcatttctttttttttttgagacggagtctcgctctgtcacccaggctggagtgcagtggcacgatctcagctcactgcaagctctgcctcctgggttcatgccattctcctgccccagtctcccgagtagctggaactacaggcgcctgccaccatgctaactttttgtattttttttttagtagagacggggtttcaccgtgttagccaggatggtctcaatctcctgactttgtgatccgcctgccttggcctcccaaagtgctggtattacaggcgtgagccaccgtgccccgccaatgctatttatttctaattaaaacccaacatatgctaaccaagtgaatcttcagacagagatgtaagagtaaccatggccagggaaggcttgacacttctaggagatgttttccaagctgagacacaacaagggtgtatgcccatatcgtgctcataatcagtgctattaagttattgtgttagcttattggtaggagccagcctctagaagccactctctggccatatgatcccaatagcaatgcccatctctctggtgttcccctggacagtttcagatgccaccaaccatgtcatataatctcttgtgctttgccttccacttggtccattgtgcgtctagactgtggtcacgtgttagagcagctgaggcaattcccaggaaaaaggcagccaggaggagtgaaggattcatgtttcaaaaatctaggaagggaaaagaaatgaggatctgattagaccgatcctaaaaagccattttactaccccctgagaaactagggccaccatggtagaataaaaatatttaaattattcttccaagcatttacctaaggactgtggaagaggccaaggatgtggctggagaaaaacagggcaagtggaggtattggagggacccaccaaaatgaaaagcagcctgtccagagctgtaggagttgaaacagttttctgggatgatgatgacaggctatgaaaaggacaggaaggtacctgatgggcgagaagcttaaggcaacaaccgggaaactaggaaaccgttggcccaggttttgtaccaattgtgctgaggtcatccaggcaaaacctcaagaatgaagacatctaatttcaagaagggacaaagggatccccaataattgggaagtcacatcacaccttgttcttggctaatacacaacagaaggtgaagtatgttttccaaatgccccttgtaatgaaacagttattgaatgtcttcccaggacaaactgggaaggagagcacccatctaccgccgttcccgcagtcctgcagtcctgcaggtgggccagtcctgccaacactccagctcccctcacagagcataaactgaatcaggtggccgaaccaccggaagccagagtccccagtgtccgcgcccacacaggggtgggtaggcagcttcccaggctttgggctggggacccaggccaggtcccctggctcttgctcccgccctccgctcatgctcactgtggccccaggacgtgggcgatgttgcagggagcaaggggcgcctctgcctgatttgccggggtcgagcctccctgtcccacccccaccggccctgggaatactgcggcctggcactccggaaaatccctcactcacagagctgaaggacttgctgggtccctggtggcccctgtccaatcttagcccactggggtctcagctgctgtagccacaggtggacaggcacagtgggcaggtgctgggtccaggagtctcctgtcgcctaaggccgcccgaaagcagctaattgacctctaaagcccctagacccccctgcccccttgccgcccaggcaggcccgcccccaccacttgcccgctctgcgattggctgcgccagccgctgggcggggccttccggcgtgctgactcctggcatgtggagcagctcagtccccttgcctcagtggaaccgggggaggggagctgggggctacgaagagaagggtcggaggtctccctggagggttcggatcaactaagtaccctatttaatgccctgggcgggtggtttatgaaaagaaatttacaggagccctgtgtgcattttcagcttaaccctgcttttcccttaggcctagaatttttgattaaaatctcctgcagggcagagagccagaggactgtaatccagtggttcctgtttagtccacagcaaaggtgcggctggctggaagaacgcacagcctgcaagcagaagccttatctcccaattaagggtgtagaagaatctgggcgtgttgctggtgtctcatgcctgtaatcccagcactttgggaggctgaggcaggcagatcccttgagcccagtagttcgagaacagcgtgggcaccctggcgaaaccccttctctactaaaaatacaaaaattagccgagtgtggtggcccgcgcctgtggtcccagctagtcgggaggctgaggcaccagcatcgcccagcccggaaggttgaagctatagtgagccgagatcgcaccactgcactccagcctgggcgagaggagaccctgtctcaaagacaaaaaaacaactggtaggaaaacgcaccctcaaaacacatgatgagatggtcgagaccagaccctaggagggtgggtactggctgggtgggtatccagagaccatgggcgtttcataatgcattgtttcccgtctcctccactcagcgactcttcttcccctgaagtcttgcattaagtaagtgaatgaatcaatcatcaagttaatgaagctctgactttgtacttgttgtcctttgcttggtacagttgggcactgccttagaaacaatctccaggtaattttcccaactgcttttgtgaggcccagttttccattttaaaatctaagattacctcagtaatcttgcttttacagcaaatgggcatggagcctgacagatatatttaaactaagttatggacaagctgcctggtgcattaggtagcataggagctaaccttgtgggacatctccccatattcgtaatattcacccctacatctataatcaataaatgcttgtttggaggccatagaaactcttcctgagatctgacctgtgtcttctgctatctgcctgatttctccccatagaacaggaaaacactgtgtaggagatattgtgaatagaaatatgaatataggccgggagtggtggctcacacctgtaatcccagcactttgggaggccaaggcgggtggatcacctgaggtcaggagtttgagaccagcctggccaacatggcgaaaccccgtctctactaaaaatacaaaaattagccacgcatggtggcaggcgcctgtaatcctagatactcaggaggctgaggtaggagaattgcttgaacccagggaggcagaagttgcagtgagtgagatggcaccactgcactccagcctgggcaacagagtgagactctgtctcaaaaaaaataaaataaattacaaaaattagccaggcatggtggtgggcacctgtaatcccagctactcaggagcctgaggcagggacaacggctcaaacctgggaggcagaggttgcagtgaaccgagattgcaccactgcactccagcctgagagacatagcgagactccatctcaaaaaaaaaaaaaaaaaaaaaaaaaagaatataaataggaaatacagtgattcaaataagcaattgttagttcctcagatcagaactgtgagttctatactagactcttacatgttatttcttctggtatcttagcaatgattctgaataaagatcagactccttagtcggcaggtgggacagttctcaataacagaagctgggttctcaggggatcccgtggatatgaggatgaaggttagaagcacttgggaccatacctgcaggtctgatttgaggacaatgagaccaagacaggaaggcagcacctgctgaggggctgggggtgggagaagggaggaaacgggacacaagaaaataagtataaaccaccagactgcagtcagtgatcaacaaaattcccaagtttatattgagaagatttccctggtttggggttttgaagagattatataagggattcgggttgcttgatttttttcattctttttcttttaacttggtctcaatttttttgtaaaaaaaaaaaaaaagaatgtcttatgtgcacctttagaactggtgaatgaatgaacctccctttttaaataactgagattgtcactgaagcactgtcatccgatttaggcttaaaaatctgacactgaatttatcctagatgataaagtgcaagtctcttgtctcctagaaatgatcaggcaaggaaacacccaggaggcccagggcaaaatgccctcctggaagctggtggggtaggaagatgctgaggcccagtatggtccctggagcatgcattctgtgtggtgacagaaattgtttgcttgaccgtacattggtcaggcttctgaaccttctgctaaacccatctgtgcactttttgtaaaattcagttttaggaaattaccctgctaagtcagtttagctggcaggaatccccgtccaccatatactgatcagggtcctcatcccccaccatcccgcagctgatgtcagataaccttggcctgtgctcagcgagaatctcgttaggtcagtttagccagaatcctcccttacccttcatgttccctcatagtcatttcctatctgctaacccccatcctcctccttgagtataattaccacttccttgtgctggattcagagttgagcacaattgctctctctcactgtaagaactacttgcagtgctcctagacctacatatgtgaacctgtttctttaacagtgactcacctgtctttttctcctttcaacttgacactagctgaggcttatccgcatcaaagtggagggactggccccgggggatcctcagggcttcaccttgatggcctgcaggctcacattccactttttctggtgccttctggctccgagtccagtttgccacacaagtgatggaggttggaaggagggatgaggtgacagaggtgaaggagggtaaattcttttctaagccctacttgcctgacatgcatttaggtttttagaaaggaacctgaccccaccctttattttctatctcccacttccatgactagccttacctgtaaaaatggggcatagaagagcccccatctcctagggcagtgtttttgagcagggggtcactgaacagtagcaccttcatctcttgagaccttgttaggaaattctggacttggggtggttgatcatgcctgtaattccagcactttgggaggccgaggctggcagaacatgaggtcaagagatcaagaccatcctggtcaacatggtgaaatcccgtctctactaaaaatacaaaaattagctgggcacggtggtgtgtgcctgtagtcccagctaatggggggctgaggcaggggaatcacttgaacctgggaggcagaggttgcagtgaaccaagatcatgccattgcactccaacctgggtgacagaggaagactctgtctcaaaaaaaaaaaaaaataaaaattcctggaaatggattagcttgctgacaagagttattccattgtgtgtttctacctgcaatacctgaggatgcccattttctcacgatttataaactaactcattttatagatgtaattttcatacatttgggggtatcgttctaacttcattattattacttcaaggtgttattatttccccatcatcatcatggtcattatcataactagttggtgctgacagtagtcaccctgcattgagaactcatactccaggccctttccacatagacttgatttaattccattcactcctcacaacaatcgtctgaaagaaagaatcactaagccattgtataattgaaacacaagaggcgagtgacttgtgtgcccttgggcaggtaatttaaacactctgtgcccccaagttccaatagataaatgtaaataataatatctttcttacctaatacatggggtcaacagttaaagtactgtacatttgtgaggtatttcatggcacctgtgaattgctcatgtgatgacttagtgtgcttccagtgtcagtgtgctgggaaggagacagaataagaagaagactgaaaagatgccgagtctagtgcagggtatcctggggaaaacacctcctgtttgtccaacagcgattggccacacattgaagacacactacctggctgtgaactggggtgaccctgttgaaatcttgtggaaagcttgagatgctccttagagggtgtttatccctcgagctggcacaaatgcggtttgttgttcagtttttccttctactctgcctctatctggtacaaaatggaattgaagaggatataaaccagcaaggaacaatctgaaatcagaatggtgacaatgggagaaagtaatcttggttcaacccaatgttcacctgaagtctctttattaaagactactaacaggaacgaaattgcataataatcttcctatgataatttcaagttccagaatttctctatggaactttcaaatttcacctctgttaactcatggaattttccctagaatctgcaaattaccgaagtctttggaggtttgatgatcactcactggtcagcggtactacaaaaggattctggggagtttgactcagtggtcagcaaaggctcttccgaatcttcagtctgattctgagattccccggggagaactggagcctttcttaacagctgttgattggaaagaccacctgcttcatcctctattgcaacagaaatagccattgtgaatctccatggggaggcacaatgagttttttctagcatgtgtgactcaggtcattttgttccgtggtttccagttgtggggacttggcaaggtcacaccctcccctgagcctcagtttcatcgctcagaaaatgaggataacaattctacttgcctcataggattgttgtgaagattaaatgagacatgtaaacatttgcttatagtaatttcacaccactttattgtggaatcaaagacagaattcttacagaggtcttggttagttaagaaaacatccattcaaagatttgattcacaggacaccctcactgtctttctctctctttttttttttttttttttttttgagacagggtctcacttcattgcccaggctggaatgcagtggtgtgatctcagctcactgcaacctctgcctcccaggctcaagagattctcccacctcagcctccgagtagctgggattacagccatgcactgccactcctggttaatttttgtatattttgtagagacggggttttgtcatggtgcccaggttggtcttgaactcctgggctcaagcaatccacccgcctcagccacccaaagtactgggattacaggcgtgagtcaccacacctggcccttgcttactttcgtacttcccaagaggcaggttaccaaattggtgaaattaaccataacatcattgtgatgggcaagcagatatattaaaagcaaagatacagcaggttaacattaaattttgctcatcccaggacaaacctggccacaggaggcctttgccagtattctgaaaagtgttgtgaccatctcctttaaagctcagttaaaggtttctggctggactccaggctgcttcaagctctttacttgtctttatcattctttaaggagggacccagacacagtatgcagaggcctgaatcctctagatcattctctctccaccatgagtcctgccgtggggacttttccagctccctttggccttatgagccagaaaatcaggctagagcctaaagagaatagaaatttcagaatcaggcttgttctgcgactgtatgggggagctgaaggacacaatgggctttctatattggagactacccatcatactctctctgcccagggagaaaggacagatgctgtgtgattttgtagtctgtgatttggcttctcattctcgctgctctctacacctcattgtttacttcactcccctgaaaaaaatgctccctaacaggctcagtacccaacttctgggtattgctgcccacatttgccttggttctaccttttcagattgcaggatcctgaggttttgcttggagcagctcagattctccactagatctaagatctcacctagtcctgaggatttccttaaagggaaggggaaagatagatagatgatagatagatagatagatagatagatagatagatagatagttgctgcctttgctctacagcatctgcttggtgaagaggctcaggatctggatcctggcctctcagctttcaggaaccccattcccccctgacaggggtggcaagttcatcctattattcattaagaaatttgaaaacaatcattcaggaattttaggtcaagagctggaaaaccccaagcctccgtcacctgagcaaagggagatactgtgagcacctgcaggatacacccatgttccaccacctgcctgaagaagcctgtggttcttgtcagcttctcaagggtgaagtgccaatccttttctgcttgagcagaagagcagaccaaagagctcattgactcaaggagcatcacggcaactgagctgcacctggaagagaagaatccagggtgtgatccacagccaaggcctgaagcaatggggcccatacttggcctctccagggtgagttgtgacccaagtgctgggctttagcccatgagtggtccctcttgccatttccagtttcctcccaaagagaggccagtgttggtgatttcatttcttataatctccttaggagcacaggttttggtttgtgccttttttggatcaggttccctgcattgcagctgctataattaaaactattaacaacaacacagcaccacagaagcaagttagttgctaatggaatttgctgataatgctgtcttctagagaccactctagtaactggagagccttggtgtagagctgatgataaaacctattcctgcttttgtcagtcatgaggagcatttcctttctagacagaggaactgaaacccacatgccagcccaaatttaccaaaagcagtcactggaatactcatcacaccatcatgtctcatcttatccctttcgttaccttcaaatacggccccatttcctcaggaccagaactcccttatgtgggcagcaggactaaggcccttgagttacctgtggtgactcctcattaaatggaggaatgtgccagtattttcagcaaaacatgaatctgatgaaacactgactgaactgtctcctagtttcaaaacaaattattaccactcagggcctctatttagggcaatcagagtcagaagtgggaacgcatcttgtcctcctaccttgattaacagtaactctaattgcaggatgatggtcaaatcctctctcctctaatgtgcagttgtgaaggatttaggctccactgctcatgcatttgggtggggcctgaatcactttcagtctagcacaggcgggtcacttcaggccttcccacctccatcagcatccttcaatcctcccctgacatctctcatttatgcttcctattgattcagaggtcccaacccaagtggctaaaagaaacattcattaacctttctacaaagtcatgaataatccatggattacattgaattcatccctactaaaaccatcttcagaaattcagatgtagtaaccttctttctgaatttttttttttttttttttttttttttgagatggagtcttgctctgtcgcccaggctggagtgcagtggcatgatctcagctcactgcaagctccacctcccgggttcacgacattctcctgcctcagcctcccaagtagctgggactacaggcacccgccaccaggcccggctaattttttgtattttgtttactagagacggggtttcactgtgttagccaggatgatctcgatctcctgacctcatgatccgcccacctcggcctcccaaagtgctgggattacaggcataagctaccgtgcccagccaagtattctatccttaatgaacacatatatgcacattatatctattttttataatatatatatttagaattgaatgtcagagtacatatcagtgttggaggaagagaataaggaggaagcacagaaagtaaaaaggaaaaataggcaccaaaaaagatttggagaatggcagatggccaaggagatgcagttgggaagtgcctcttccatggagaggaacccaaatatctagtaaaccttcacattttaaacagatcttttgagagaaaacactgaaagttgacacagaggtgacacagacaccatggttgaagagggaagaaatgggacagtctgctcagagtcactagacatcaggactggcccatataccctgaacaaacccaaggaaggggtgagtgaaggaaccctgggacactacatacccataatgtacctctgagatcctagttacaggagtttctacgaccctcatagatctttggactggtaggagagctgcctcgagcacatgcagaggcacagtttgaacccacacagagcccagaaggctttgttgtgctgtgcagctgcagcaaaatgcaaccctaggtgcccatcccacaagcctccatttcatactgagtggctaagttcctgctgtccgccaggctgggagtgaaccgcgcctggcctgctcacatgcccaagataggccccatcaccagtgctgtgtgattaagttgcatctggtccacatgcccccttgcctgtcaaccccttcccagagctcatgcctggtcacgcctgcaagagggtgtccacagcacagcatccactgcatagcttgagtgttttgttgacagcctgggaaaagctcaccaccctgtccccaagtcacagccagtgcttgaagcttagaggccagaggacaaatccgtgagcccagtcccaactccccaagactcaagtataccacccagggacactgagctgagatttgtaacctaatctcaagtgaaggaggatcctccatagtcagaatgcagagaagggtgtggtatgggttctcatgggggcatgggagctggacacccctccctttgcaagaccagaccatgaagggtatggcctgatggtggtagcttctttcccagggagtgtcctggcacagaatgcctggagcagctcaacaatgtgggagcagatggcttggggaaagcctagttggttgggcttgccgccagggcgagtgtctgtgggagatctgctgggtcaggggagtgtaagctaggcagactccatggttgcctgctgggctgaaaatcatgggctgcagactccatactggtgttgcacccattgtgccactgccctgcctggagatcctctacccttgaaatactgcatcatcagagcaactgcagacataccctaaaacctgctctgactttggtaagcacagtggactggtgggtctctggagagctgtgtgtccctagagatgtaatcctcagtgtggaccatccctaagggaagggggagtgcagcctgccaaagcaccacatgagacaaagaaaatgtggccatggcataagccactgaaaggagcaccaccaaggcccagaaccagacttggagaaggaattatgtctcgcctccatctcccctccccagtgcactgttgcagatgcaacaatagctcttcccataggggcccagaaagcgtgcactgaaagaagttgtttctcatgattctccagtgagggcaagcatgcaccaagaccccacctgccagctcttactcttaagtccatctaccagactgaagtttgagttataccatcatataaaaatacattgctaaaacaagcaacatctgtgaaagccactgcagcaacctatctgtaaccaaggaacatatatggaaacttcaccctctgcaactacagagaaatgaagccaatcaatcacatacaccactgtcatactttcaaagagaataaaaaatataaaagccctgtgatggttaatactgagtgtcaacttgattgtattaaagggtgcaaaatattgttcccgggtgtgtttggagggtgttgccaaaggagattaacatttgagtctggactaggagaggcagaaccaccctcaatctgggtgggcaccatctaatcagctgccagcacggctaggacaaagcaggcaggagaaggcagaagagcagacttgctgagtctcctggctttcatctttatcctgtgctggatgcttccagttcttcagcttttggactcttggacttacaccagtggtttgccaggggctctcaggccttcagccacagactgaaggctgcactgtcagcttccctacttttgaggttttgggactcggactggcttccctgctcctcagcttgcagatggtttattgtgggactttaccttgtgatcgtgtgagtcaatgatccttaataaactccccttcaaatgtacatctatcctattacttcggtacctatagagaactctgactaatacaaaccccatctaaatgaagcaaattcaaaaaagaagtgtcaactcccgcagatggaaaggaataagcacaagaagtctggcaatacacaaagccagagtgttttgtgatctccaaagcctctcactagctccctaggaaaggatcctgaccagatgtaaatgtctgaaatgagacacatagaactcagaagatggatgtcaaggaaagtcaatgagacataagacaaaatagaaatccaatgcaaagaaaccagaaaaacagtccaagatttgaaagacaacatagttatattaagaaagagccaaactgaacttctggaactgaaaaattcactaaataaatttcaaaatatagttgggagacttaaaaacagactaggccaagcagaaggaaacacttcaaagcttgaagactgattcttcaaattaacccagtcatgcaaaaataaagaaaaaatattttttaaaaagacaaagccttcaagaaatatgggattatgtaaagaaaccacttctacaacttattggtattcctgagagaaaagaaagagtaaccaacttggaaaacatatctgaggaaaaaattcaagaaaatattctcaattttgctagagatgttgacatgcatacaccagaaatccagagaacctctgttatacactataaagacagccatccccaagacacatagtcgttagactatccaaggttaacacaaaagaaaaaacaaatctcagacacagctagagaaaagagcaacactacctacaaagggaacccatcagactaacagtggacttctcagaagaaaccttacaatccagcagagattagaggtctatttttagtactctaaaaggaatgacattccagcataaacattcatattcttcaaaactaagcttcataaacgaaggagagattgagtctttctgagtcaagcaatcggtaagggaatttatcaccactagactagccctgcagaaatgcttaagggagttctaaatgtggacatgaaagaacaatacacagaaaaagcacagttaagtacatagtccacagactctataaagcaactacacaattgagactgcaaagaaactagctaacaaaactatgacaggaacacaatctcacatatcaatgttaaccttgaacataaatggcctaaatcctccgcttaaaagacatacagtggcgaattggaataaaaaaatcagaatcacccatctgctgtcttcaagagacccatctcacaactaatgacactcatgggttcaaagtaaagggatagagaaagattaatcatgcaaatggaaaacataaaagagcaggagtttctattctcatatcagagaaaacagatcttcagccaaaaacagaaacaaggacaaaaaaatgttattgcttaatgacaaagggctcaattcaataagaataattaactatcttaaataaatatgcacccaatattaattggagcatcacgatacataaagaaatcactactagacctaagaggtagacagcccctcagtaataactgggaacttcaacactccactgacagtggtagatagattattgaggcagaaatctaaacaaataaattctggacttaaatttgccacttgaccaattgaacctaatagacatctacagaacactctacccaacaaccacaatatatatatttttttctcatcttcacatggaacatactctaagagtgatcacatatgcagttataaagcaagtgtcaagaaataaaaacaatcaaataatatcaagcatcttcttggaccgcagtagaataaaaataaaaatcaatagcaagaggaactctaaaacacagacactcacacacaaacacacacggaaactaaagaaattactcttgaatgacttttgtttgggtaaacaataaaattaaagcagaaatcaaagaattttttaaacaaatgaaaatagagacacaatgaacaaaaacctctgggatgcaataatagcagtttaaaaaggaaagattatagtgctaaatacctacatcaaaaagatagaaatatctcaaattaacaatctaacattgcacccagagcaagtagtaaaacaagaaaaaaaactacatccaaatatagcataagaaaagaaataacaaaaataagaacaggactgaataaaatcgagactcaaaaatccacacaaaggatcaacaaaatgaaaagttggttctttgaaagtgtaaccaaaattgatagactgcaagcaagattaacaaaaaagaaaagatccaaataagcacaatcagcaataacaaaggcgacattcaatcgagtcccacggagattcaaaagattctcagagactactatgaacatttctatgtgcacaactagataacctagaagaaatgaatacgttcctggaaacacacaacttcccaagattgaaccaggaagaacctgaaacactgaacagaccaacaatgaattacagaatgaattgaataagtaatagaagcctaggactagatgaattcatagctgaattctaccagacatacaaaggggagctcatgccaatcctactgaaactattccaaaaaatcgaggatgagagattctcctctaacttactctacaaaacctatatcatcctgataccaaaatatggcaaatactcacacaaaaaacaaaaccctaggccaatatatctgatgaacatagatgaaaaaatcctcaacaaagtacttgcaaaccacattcagcagcacatcaaaaagataatacaatatcaagtgaactttatacctgggatgtaagagttgttcaaatatatgcaaatcagttaatgtgattcaccacataaacagaatttaaaatgaaaaaaaacataagattatctcaacagatgcaggtaaaacatttgataaagtccaacatgccttcataattaaaaccctcaatagactaggcattcaaagaacatacctaaaataataagaaccatctattgacaaacctagtctacgttatactaaacaggcaaaagttggaagaattcccataagaataagaacaagacaagaatatccactttcaccactcttattcaacttaatactggaagccctagccagaatgatcagacaaaagcaagaaacaaaaggcatccaaataggaaaagaggaaattaaattttatttcttcactgatgataggattctatacctagaaaaccctaatgattctgaccaaagactcctagagttgattaaaaatttcagtaaagttttaagataagaaatcaatatacaaaaagcagtagtatttctatacaatgcaatattcaaactgagaaccaaatcaagaacacaatcccatttacaagagccacagaaaaaaaaaaaaaaaagaaatacttaggaatacctctatccaaggaggtaaaagatctctttaagtagaactacaaaacactgctgaatgaaatcatagatgacacaaacaaatggaaaaatattacatgcttatggattggaagaatcaacatcattaaaatgtctttactgcccaaagcaatctacaaattcaatgcagttcctatcaaactgccaaagttatttttacacagaattagaaaatcaattctaaaatttgtatttaactaaaaaagagcctgaatagccaaagcaatcttaagctaaaagaacaaaggcaggggcaacacattacctgacttcaaactatactacaaggctacaataaccaaaatagcatggtttgggtacaaaaacagacacatagaccaatggaacaaaatagagaatccagaaatgaagtcccatacctacaaccaactgatctttaacaaaattgataaaaatacaatggggcaaggataccctattcaattaatggtgctgggaaaactggctaaccatattcagaagaatgaaattagactcctgtctctcaccatataaaaaaattaactcaagattgattaaagacttaaatgtaaaactttagactataagaagcctagaattagacctaagaagctcttttggatattggcctatgcaaagaatttatgactaagtactaaaacacaaaagcaacaaaaacaaaagttgacaagtgagaccaaattaaactaaagagcttctgcacacttgcatgttatattgcaaatatgaaatagcaaagacatggaatcaacattggtttccaacaatggtggattggataaagaaactatgatgcatatacaccatggaatactatgtagccagaagaaagaatgaaatcctttcctttgcagtaacatagatgtgcctggatgccatcatcctaaatgaattaagatgtaaacagaaaaccaaataccgcatgtcctcacttataggtgagagctaaactttgggtacacaggagcaaaaggatggaaataacagacactggggactccaaaacaggggaaggaaggaaggcaaggtttgaaaagctacttattgggtactatgtttactattcagataatatgttcaatagaagcccaaacctcagcatcatgcaatatattcatgtaacaaatgtacacatgcatgcttaatctaaaataaatattaaataatcaaataaaatgaataaaacggtagatatgattatgtggaaaatgctttactatttattatgtggtgaataatttaataatatttaataaatacatgaatgaaaaatagctacaactgtgtgttaggatttcaataattttttatttcattcctataacttttatgtattattatatacataataatatatagttaataataacaaaaacaacatggtattgaaataatttccacccagaaggaggatcaacatatttaagtgactacactactcaagataaaaatcatttatcaaacagatcaaagtcatttacctgctttcctttttataggtcctaggaacacacgtgccatagacaataaaacatcacttcccccatcccactaccttggactttatttaacatctttgggtagaacagaaactgttgataaggtgagttttgttttatagacaagagaggaaaatggatactttgtgtggtctgggccttagaaacagactaagatcttttttttttctcttttgctttttttactagcataaaatattaattgacaaaacactgaatacaagcttcactatcataaaatcaaaacatttaagcaatattccaaaaaagatttgacaaaaactagtcaccaagagtacaaaaattacacatcaacacaaagcataaaaaatgtgaactttcaaattaaacagtcaaaaacatgtacctgcgtgatcacctccacaccttgactgccttcgtctgcagcacgctgctggtaaaggctgggtggctgcaccgtcgtcccctaacccaacattgctttcatctgggaaaattcgcttgatagccaattaagccatggaggctattacatttacacggggctacgcacaatctcaggggacgttcaaacagcagttcgttcctcacacgcactgttgggtgcaaagggcacctggagagtgagggagacctgggagctttcctgcggggccttggccacgcggccgtcgccggcaccctgtcccttgcctggcaggggacacaatatttgtacagattatggtataatttgaatgattttctaatctacttatcttaatttatatagtttatttaaatgtcaaggcagagaaatacattgatcatgttaaggtcacgtgatgtggtggcgcagtaatgacttcctgaggaaacagaaatcggatgttttgtgatttagctatgtgcactaaacttattttccatgttttgagagcacattaaacattcacgtacaatgtgggaataggctggctcgtaaccaaaacgtccaacccaatgccaccctttgaatcgctgtgaacaccatcctattgcggttcagagaaaacaagcaaggctgcgaagccccggggttcaggcagctgcagcgcttgggccaaggtagctccgctctctggtctgaagccacgtggccccaccccggggcggcctggcttttttatagtgcttattgctgtgtttggcatgccattcaacccatcgggatgttggatagtgacttgagagcaatccctagatttgccctgtcgggatgttgcatactgaattcggaataagccctgctcaactgaggcactatcactaggaggaggcactgattcccgcctttcaatgctatctattggtgaaagaggagttggatggcatctgggaaattagtatcacttctactttttcttcttttcttttaaaggttaaaaataccttgtattagttaatactgctataaaatatgaatatccaaatctctgtggctcagtaaaatagatttttttttcactcagagaaagttcaggttcacccttagtaacccaggctgacagagactcttccattttctatacatagcttccccaattgcccagagaagagtggaaagatttgataggtgactgtacacaagaataagaacttagtacctagtcactaatttactcgttgaataaacatttatggagctgaacatattaatcactgggcagacgctgggacacaagaaaaatctttaagatatgtcactgcttattaccaataatgttctagtgagtaacaagagttaataacacgactaattatagtattgtaaatataattacagttccaataagacatacacacacacagaacgattttgtctggttgttgaggaaatctttattgatttaagatatcttttgatgaacaggatttttcaataactatcagaaaaagaatgtctatgacttatttttaaaaactattttcttatctgccttgcatatctgacactttcatctcctatcttccttgaatacaatatagaacctgacatttctttcctttcaaagatccttagagcatttcctacatttaatctgaatgtctttctcagtaatttttcccatacaagcaattatggctacattttcttaatataatcatgaaaaggtgagcaaaactgaaaatttaatttggagaatagatacgaaacattcaattaattcaagttgttgttaggctgcatatgttcagctttcagtgaagatgaacaaatgatgataaatgagaaactgaaagaaaacaaaccaataggtgttttttaagaaacaatattattaaagtgcatgtgttttctactgaatgaaagcaacatagaccttttcctcacattggtagttagtaagatgtataaaaacaactttgtaaagaacaattaatacaggttaatgaatcattgtgaaaaggggataacacactttattgtagcaatgatctgcaaggtgttaaatgttaaaaaagatgaagaacaattgagtagttatttgatcacagtgtttattaaattgcttttcctgtatctggcaagctttacagaaatgtcttcaacagaataactgtgttaaaagccaaatgaaatgcattttgaaatatgattcttcacttggtgtgcaggtataatctcaggtgtaattcagacaagagacaaattcaattttaaagttccatttgttacaatttgatgattgtgattaaagaaccataaaaattttatctttgacatttcattttttcctcacaaaagtattctactgcaattttcttagttttctttcctcttaactgtggtgttacctataaatgctggatttctctgttttacgtgcaacaaatctacaatcaactatttctggaacgccacttcattttaacaacaaggacccataaatattttaaaaattcaaaatgttatatataaaatgttaaatgatacacataatacatttctaagtagtaattatgattatgcccataattatacccataatttaaaaatatgttacctgaagtaaattattatacgttttatgttggaagtgttcatttatctttgatctctgttaacacattgtactatgtggtaataatataaactgccttactggatagtgatgtatctttggtttcatattgttactggactaatattccaacactatagatagtgaaatttaacattgaaacaatttgataatgccatcaatgaatccagtttttaagagtgggatccattttctaaaattgagtatatagatacttcatgagatatcttatcatgcatcctaaaccaaaccaacctcttcccctgactgtcttacagtgtattattattattttatccaccacagcaactagtacatttttcagaacctagtagatattcagtcattgtctatggaatacatgaacacattctgaatttggacagtcatcattcttggtgttttaaaacaaacacttcctgaattgcatccactattttctaagaagccctaggaattcattgaaggagggtatgggtaagttgtgggtgaaactgtaaagatgtaggtcctcctcccaaaacttcttcagcgtatcttcattgctgtttgtttgcttgcttgcttgcttattttaaaagagatctagatatagtctaataagaattgtataaatgtgatgttccacaatgattctaacttacatggtgcaaaataataaaatattacattctacctgtttgtagaaaaccatggatactataaaggatctagattttctctctcctttccttctaagatttattcactcagcaaagacttacctggtgactacttagtgctagacactgttttagatacttgggctataacagtgaaaagaacagtaattgaattaatgaaaagttcattttaattagctgtatggtaaaataggaaactaacaaaaataaaatataacatgtcaaatggcaatgactgctctgagaaaaataaaggagaataagagattctaaattattatatacggccaatattaccaacatattatagaaagaaatgagttcataatgtttatcagagaattccatgaaaatagctaaatttttctagaaagccaggcactgataagagaataaacaaacagataaccgattttaatttgatcttctcttacaggtgcagctatgatctgccattgtatataatataaaattgaaaattgtttatatttcattcacgttagcatataatgttcttacttttttttttttttgagacggagtcttgctctgtcacctaggttgaagcacagtggcacggtctcagctcactacaacctccacttcccgggttcaagtgattctcctgctccagcctcccaagtagctgggactacaggcaggcaccaccacgcctggctaatttttgtattttattagagacggggtttcaccaaattggccaggctggttttgaactcctgacctcagatgatctgcctgtgcctcggactccaatagtgctgggattacaggcgtgagccacagtgcccggccaacgtttttacatttaaatatcagacatctatcatattcctttctccctactacaaacattgtatgcttttcaataggcataagattttgttttcactcaggttggattcaacaggtattatttagcagttcattgcatctatccatttacccaatagaggaagtatacaagatacaaatgaataaagtgtaataattcttatactatttgcccttatgtcatgtaactgctccatgtttgtattccgaaaacctaactgggagggaaaactcagaaaaatagaataaaaagtattatatatctcatacatcctcatttttgaatattctaggggtacagatcagtataaataaaatactctggtaagtgaccaccacatcatctgtttgtcattcttagacccagagtataccattcttttaagaaagaaaacttgctactgtacctcctacccagtaacatatatatcacatatcatatatatatcataacatatatatcatatatcatatatacacatatcatatatctcatatatataacatatttgctactggttaggagtaacactcagaaaattatacttaataatgtagtacaattaggtataaattcacttagtatttttaaattttacgtatattcctatttatatgaatcgtcatttaaaatcacatctactgatcctgatagcattaaaggcataagaggtactgaggatattaatttaattttgtttacagctatgcacagatatttttagttcactgagatttaatccagtagtctattatttgattaattgtacagctatcaaatcattcaggactcccactgtttcaacaacgagagtggaaaaatattttttcatttatgtttatatgcagctatttgtagtctaaattaatatcctagcaattgatggtgaaattaaaattatttctgtcagatgtggtaatttgatgacagtggataagcatgggaataaaagaaagttttgaggaagaggggacagtttttgtttacttaatgattattccaaagatgttaagtaaacattctatagaatgcaacatatagtggaatacagcattgaaacaatttaataatgtagtcaatgaatccagtttttagaaatgggatccattttctaaaactgagcatacagatacttcatgagatgctttatcacgcatcctaaaccaaaccaactccttcccttgactgtcttgcagtgcatagggcatctctacactctaggaaaggaattatcaatctgtttatatgccacttataaaatcatacttaatgtacgattaggcataaatttacttgcatttttaaattttgtaaaatgttaatggaaagtgttcttgaaaaacatttctgagaattccaaaaaatgaacaaattttaatacataagggacaatatctttctagtgaattgattatcagagtgtaatgtggtatgttctgattatgttacataatattctgattagcagaaaattttgaataagtgaatttagcaaaatgtttagaggtcaagaaaactgttttagactgactatgttttctgacccaaatgtaagaaagaacccaataaaaagaggcagccagataatgctgttgtttgcaaacttaaacagaagcttgcatgtaatttatgactcaaagaaaaataaaaatagaagttatactttatttagaacttaatgacagtgaaaaattgcacataaaaaggaagactgttgaatacagcaaaagctggaattatataagaaatataaacataaacacacaaaataagtgtaaattataatgaagtaaaaatatatcaaagagaaagaaggaagcagtacaataaaaaataaagttgattctttaaaaaccatacttaaatagacaaatttccagccagattgtttaccaagtaaagagaaaaagaaggagatagatcaaaagacacaagatgatgatgaaaagagggtcagcacttataaacatagtagaaatttaagccataatgagcacaagaaagcattatcaacttacttttgaatatataaaatagacacttaaaaaactgaacaaaaatgacttactagttttaaaagaaaaaaaaaaaaacatcaaacatctatccttccaaaagtatagacttcaaaagtatagtcccagatgggtgaacataaaccacactttaagcaagaactctcagttataaccacatgggtgaacataaaccacactttaagcaagaactctcagttataaccagatgggtgaacataaaccacactttaagcaagaactctcagttataaccagatgggtgaacataaaccacactttaagcaagaactctcagttataaccacatgggtgaacataaaccacactttaagcaagaactctcagttataaccagatgggtgaacataaaccacactttaagcaagaactctcagttataaccagatgggtgaacataaaccacactttaagcaagaactctcagttataactgcttgcagttttagaggatcccagccacactcctgaaccagagcttggcactgggtattccctctggaacacccttttatttccttctctaagcaaagacatggaatcaacctaaatgcccatcagtggtctgctggataaagaaaatgtggtatataaacaccatggaatactatgcagacataaaaaaagaacaagatcttgttctttgaagggatgtggatgtagttagagaccattatccttagcaaactaacacaggaacagaagatcaaacactgcatgttctcactcataggtgggagctaaatgatgagaacacacggacacatagagtgggggacaacacacactggggccttttggagggtggagaattggaggagggagaagatacaaaagaataactagtggttactaggcttaatactggggtgatgaaataatctgtacaacaaaccaccatgatacaagtttacctatgtaatgaacctgcacttgtacccctgaacttaaaagttaaaaatgaatgaagcctgtcagaaccacccatttagcagtctaacattttccctagtattcccaaatccctttgcctagccaacatttttcacagcactttttgtcttcaaactactggcctgaagcaatctggcttagctttctgagtagctggaattgcaggtgtaccagtgtgcccagccacagttttttcaagacctgtttaagacaacaggttagagaaaatcaagataatattttgagggggaagaaggtaaaatcaattaagacagggtgcacagagtacttgaatggtacagataatgtttatcctttgtactaaatggtgtgtatgtgggaattggttatattattttgactgtttgtagtcatattatatacatatgtgtataaataaaaataaaagaaaaaatataagctaaatttatagatatattaattttatttaaatataacaaagatttgccagtattcaaatgtctgcaatgattcttaaaatgcacagaacctgtgtttaggtacagtatcactgttcatccagccttcattcactcgaatctactcttacctaaaatttgtaccgtaagtaaaattacattctgtatgacagaaagcaaattacaatattagaacaacattatggaaaattggcataacattgtacaatcatccattactttattatttatcattttgcaaatttttattatattagtaaaaaagtctaactgtacttaatagctaatacatatattatttgatatttttaaagaccattattaaaataataataatttgggggtgagaaggcctattgaaaaatgaccaacgtggaaatcataaataagtttgatgcaacaaatatttgtgagtcttatagttaaaaatgtaaaaattcattataaacaaagctaaaagacaataatatgcattgggaaatatttgcaacatttacttcaaaggtggatgtccttaagagaatttttacaaattaataaacatttaaaaaggtgaggagtggcaatagctatgagagacaatttacaaaaacataaaaaatatgaaaactgtttaatctgtaagtacatcaataaaaattttattattgtagttattttatctattaaattaggaaaggtcaatacaattggtaatcttccaagtaaatataggggagaaggtctttctcatacacttataagaatattattttgttagaatgcaattaaataaacacttggtaaaaatccatatcctttgtccaaacaatttaagttctagacctctagaatccacatgtacatatacatatatacatacatatacacacacacattcacacctatatattaacaactcaaatccaactccaactcttttgtaagtagtattttgtccaacaaataaatttatctcaaattcttcttgacttttctccattatagagccagcaattctacgtgtaactctacctctaattcctttatttgcatttatttctgctttcaaacccttatatgaggcaagtgggattaatttatttcattaccttaactagattcatcgctttactttgtcaaactctgattgatttgctcaactcaatcttatgtgttcaagaacttaatgtggattcctgttccaccttatgaaagtcttttccaaaaacttgctaaattcttgactcaagacattgcagtcagtaatgcatttctctcctcaaatacaatggaactgtgttctaataaatactcttcaacaatgtgcagttatttctccacaactatcaattccccttaaagcagaattttactaaaaatggctttatccttctggggataatcagtaaaatggcaattggtgggtgaattaaaaatatactaaaagcagatggcagaacatgagtgcagatttttactacaaagcttaggaaaagcaaaaggaacttgaatagagaaaatgcagaaaagccctcctttggctattaggacggagagagcagaagtatgtttagagcttcaaagagtctgactctttgcaactgtttatcttaggactttaaggaagtaaaaggtgcaagtgaaacactctggattataaaatagaatctgacacagaggattcaacccagttaatatgcatgttgcttacatggaaatgctgagaaatttttagcaaatagatagaaaatgacagatggtaggtatatagaaaataattgtaggaaaaaatgtaaaatgaagatttatggtattccttttatattttattttgttaatatgttgcccataatgctttatttcaaagaatgcaaaaccaaaaaagtagtcccttcctaacttcccctgcagccttgtcttgtggagcttgtattttacttcatgagaaatgccaaggagatgtcatttaagctgaaaacctccagcagaattagccacaatatttgggaaaaagatgtttccagaaaaagaaagagctagtataaatgtccttaggcaagaaagagctcacgatgattgaggaacaacaacaaaaaagattatttcactcaagaaaagtgaattgggagtacagatacaaatgatgaggtctgaatatgattcatggggcaggtcacactaggttgtttgggtatggtctaaatgaatgcgcggcatgagttgctttaaggagaggagtgacatgatttgacaagttcttaagagatccctttgattactctggggagaatagaacataaagtagcagaaatgaaagcaaagggagatagtaggaaataattgcacatttataagcaagaaatgatgttggcttggactctggttatagcaacaaataaagaaaaaaggaaatactgagaagagttgattggatttgctgacattctcaacataaatggaagtcagtatttttttctaataaatataatatgcgtaaatatttttaaatatttaattcttttaccactaatggggcacgagtagacttcagggaacatgccagtacagaaccatataaatgtgatcattggtagagataggaattaataggcatttgaatgtctccctcaacctggaataccacaaataaagctctttgcttttcatgttgcattgttatcataccctatagttttctgccattttcagttacttaatattatgttttgcctcaatagattatagtgctttctcttgttgtgttatatttgcagcaattattagtgaagttttaaacttcaatatcacatctaaaacagagcaaaattgttgcatactattttccattaaaacatgagaccactatgacaaaaaaagctaaacatgtcatgaaatgacttacattggatgaaagtatatgcaatatattaagaaataatctctgactttatagttttttatttgtagtttttactagaacgtgaaatcaatatgtgaaccctggctggagtttgcatctaaatgtaataaaataaaagaaactttaatattatcattgaagcattaatgtacattagcgagctggactatataaaataaactttattatatttagcatttgatttttatttatgtatattataaaatgaatatagtttatattataataaaaataaaagaagtagtatgttaactaattagtataagatgcctacaaactacatatctgcctaaatttttgacccatgaaacttcaatgatttgtgttaatgttaaggcctacatttatttatatatatatataattaggggaggaattgttaattctttcattttaaaaattttaactttgcagacaaagttgactatacctgtggcagaacactgcaacagctataaataaataaataaataaataacttttattttctgtggagctcccagaattatgaattattctgtagattgagatttgccaaggtccttttcttagagttgcaagagcataggagaaagtcaagggaaataataagcagcacttgatttcctttaccacagtggatgggcttctaaaaccaaattacctgactataaatccagatctatcttctgcaggctatgtgattgtggatgttacctcttctgtgcttcaatttcctcatctgtaaaatggaattatagcctaccctattttgtagtatagtgaggataaatagaatgaatgtatgtagttcttagaatagagcatggcacgtgataagtggtcaataaaatattgtttactactagttatgtaacagtcacttcacacataataatgatttaataaaggaataagaagaatgtagagcacagcttctcaacattggcactatgacattttgggtcagacaattatttaatgcagagggggctataggatgcttagcagtgtctctggccagtagtgtacctcctcctctccaagttttgacaatcacaaaggcttctagacattgacaactatcccctgaaaagtaaaattgtccctgcttgagaacacaaatataaagtaaccactcaaagattacattactaattttaattgaatttgaccagcattatgaaataagcataagcttaagtttctacccttgattttgtcattgtcagttagggcagcagagaactccaattctgaaaattctgaacatgtgctaataccctacaatataatcaaaactttcatttttgaattgtatttcttaaaaattagaaaatttattaagcagcaacatggaataattaaccacaaaaatgttgaacataaatctcatttgcctaagttctcttttgaagtcctgtttcactatataagtattatgtgttttgtttcacagctagataacagccagttttttctctgagcctaaggttgcttctcaaatttatggtggcttatagctcttctaagtttctataaaacttcagcaacctgcagcaggttgaaatttattgatattgagttattcaccaggtcatattacaaagtcagggactgactcacccaaaccagatgctccccctgccaccagatcactaggagatattgcaatcatttcccctggctactaaattagcaaaaattctcagggagagagaagggcaagatggcacagtttaatacttactattattcttttattctttatcatcattccctttgaatggattaagaatctgacataaatataacttgctaaagaaagggtgttaggtgagagggaagtcatattggtctaagaaaagtcttagagaaatatttgaaaagaggtagagagaagggttggattggagtgggtgggtggggaatcacactaaggagatggatcattcataatttctttagacatggtgaggcagccacaggagtctgaacttgttgaaaccctagtctgaagccaataaaagtgctcaataaggtcacactttgatcttctctgcctaaagcagttattcaccctatctttgggagaggaaacatctacaaacctttgttctctttgttagcagagggatgacatgaatttgggaaaaacgtttgagagacaaaatgagatttagctcgagcaagtgatcgacttgtgctgggttgcaaatggactttttcaacaggcaggttgaaactgtgcttcagcaattaggataccagatataaacatccatgcacagaattggaaaggttcagctttcatggttgctatggtttgaatgttccctccaaaactcatgttgaaacttaatccaaaatatgacaatatagagaacgagctttttaaagaggggattggatcatgaaagttcttccctcatgagtggattaatccattgataagtcagtggattaataggttatcttgggagggaaaccattagatttataagaaggggaagatagacctgagctagcatgttagcatactcagccctcttgccatatgataccctgtgctaccttgggactcttctgagagtccccacaagcaagaaggctctcaaaagatatgccccatcgaccttggatttccaagccttcttagctgtagaaaataaattcagttctttgtaaattactcagttttaggtatactgctataagcaacagaaaatggactaagacaatggtcttatccagaactttgtaaactagaattggctgtttagattcagtatgtattttttttatagattcaaaataattttgttttgaactgtacaatgaaggagtgtcataagcttttccacatgtagaggctctaaatatcagtctggcattgtgataaagcagagagtttaaacccaatcctatttgtgccccatgaccgttctttctggttacagttcagaaaagtaggaatggatgtgtaactcaaggagaagcatataatacatgaagctttttctcaaaattttgatttagaaaatgaggtattttagtatgttaattataggcatctcaactgagaagtctaatagcattgggccagaattgtcgcagcagtccaaagccatggataaacttaagttaaagggagcaaatactaacagccttccaaattaatctgtattggagaagatgataaacagatgaatgggaactagaaaccatgcagacttggaactagatataaaacaaacagctatctaatgatttcttatttactctgagcccaagatatttttgtatccttttagttaaacctctgttttactaaggaaatttaaataagattctgtctcttgcaagaaaataacatctaagacatcttcgtatttaatactgccttaattttgtttactccagtggtccccaacctctttggtaccagggattcgtttcgtggaagacaatatttccatggacagggttggggggaaggtttcgggataaaactgctccactactcagatcatcaagcactagattctcacaaggatcaaactagatcacttgcatgcgcagttcacagtagagctggtgcttctgtgagaatcaaatgctgccaatgatctgataggaggctgagctcaggagtaatgctcactcatccacctctcccattctgctgtgtggcccagttcctaacaggcccggtaccagtttgtggcccaggggttgggacccctgttttacactataacatttccacacgtctctcatggcctttcagatccactgcttgtctcaactcaagtccagctacctgaaaattcgattattttttcaaagtgaatttgaatatctttatgttgaatacacagtctccacttttacgcagcccctactgtcttctatcatacctctctagccctggaagagatcaactttacattcacttttcctgttttagggctattattttatcttcaattaccaaaatctatctacatttagatactttaacttgcaaatacatagtaaacaattacagattatttaaaatagcagttttcccatgagtataaaaaaaaagaacaataaaagcaatatttgttgagtattttaaagtgccaggcactgagcagtgtgctttgcttaagtaaatgtttgacaaaataaaaggtcctttaaaagttccatgctttaacattaataaccatataaagataaggttagacttcctatcaaattagcagttttgtgaagataggccttttctgctatatagaatctcctcaaacctgagtgttcgtattatggattatctagtatactccatagctatcaagtttgtgtatgtttctttctcaagcaagttatcttatttctccttatttcttcagacttatcctttcttttcttttcttttcttttttctttttttttgagacagagttgcactcttgttgcctaggctggagtgcaatggcatgatctcggctcatcacaacctctgcctcccgggttcaagtgattctcctgcctcagcctcccgagtagctgggattacgggtatgtgccaccacgtccagctaattttgtatttttagtagagacggggtttctccatgttggtcaggctagtctcgaactccgcccgcctcagcctcccaaagtgctgggattacaggcatgagccaccgagcctggcccctaacctctcatttctaaggaaatgacaaattaagtcttttatgcaaatacagtgtagggtcatttaaaaatattttttgtaataggtgtctctgtacataaatctatttaattttttctcttttacagtaaaaaaggcaatactgtgttttagtttcaccaaaaatttcagtagaccaattgtgtaaagggatacatttatatgaatttttttgacatagtaaaaactaagaggggaagttattcaaatatttcagcataaattccctttccttgaaattgcaatcgtcatgtgtagctacaattcctcagcattcctctgtagtataagtagctacaattcctcagtataagaaacactaaggtggaaaattaattgttaagagaacaaagtcataacaaaacaacaaaacaaaaaagtaggatatagaaacattaactcaatatcactcttgaagctcacataagagaaattattgtactagacactgtggttcatcatccagaccccatcttcatgggaagacatcgatcccacactcatggggaacatcagcagctgacaattcacacctgtacctttcactaaatattgtcctaagacaaactaaaatgaactaactcgcccaaagtggtgcctcctttcagagagcagccattgacccatggctggctaatgtagttatacaaacatgcaactgctttgcatcaatttgggacaactctgaaagaggcccagtaggattggctgaagactcagttcaaagttgtcaaataaagcacaccatgcccagctgaatttacattgtttactatgagtatatcccacgaaatatttaggaattacatatactaaacattattcatgatttatatgaaatttaaattcaactgggcaacttgtacttttacttggtaaatctgggagcttttccttagttgcatctgcatggcaggtaagcatgtcggtatgcccagacctcccttctttgcttccttataagtgcgtcccagaaaacaagcaatcatctcagagccaataggcattgaggcttttgataatcaaactcccaaaggtcaaggaaaaagagagtatcccaaaagcaccaagagaacaaacaaacacataacatacaatggagcttcagtatatctggcagcagacttttcagtggaaaccttacagccaggagagggtgacatgacacatttgaagtgctgtttatgggtcccttcggattgtaacggggaaaacaagaattgtagcaggaagaattaaaagaaaagagagaagctttttttttttttaataatctgatctttttctattgagaggcaggcacccaaatgctgcttctgtcggggagtgaatctgtaaattctttgtaactctgtgctacctatttgttaacctgtgtaatttgttctcctgctgacttcttgcaaacacttgccagtgggtatctgaagcctcttacatcttctgtggcacggacttggcctatatttagcatattcactcatctaaagtgggaagaagaatctggcatcttttctctttctccatcttgccatcaaaagctgcctcaatgagcatgtagccttcagaattttgaaagcaagaagcaggcaacaactggccatgtttagcttcatcttgaaactcttgaggacacctatcaaactttcccaaaactgtctcatcatgtatggttccattgcaggatgggtgcaatgctgagtgccagaaggagagggatatcccattctttccttcttaaaaattgctcccagtctttttgagctctcttcctgtttggaaggagaactaaagcaagtttagttctccttacaaaagagaaaataattaaaagcactctcacttaggtaactaattcactttctatatgataattcttagaatgtctagtcctctctttacataagagtacaggtaattgaggtcagtgaaggttttagttacagaactggtctggctactttttattaaaacctgcaaagacttaactgttcttctataatttagggatactcatcatttaatagggaataaacaaaaatttgagacaaaaggaaattctgtatccatttcatatatatacatgtaaattacatatagaaaaaatggtttagaagaggagttaatatcaatttaaaaacgggaattttaaagctgggaataatacatagcataaatatgtataaggattcagcaaaatgttagttgaaacagggggctaaataaacttgaagtttaagaaagttaagaaatgaacccaaatatgcataaatctgaggacaaaatttgatattgctgctaataaaaaagggaggggcatcatattgggaggcttcattaataaaagtaacaaattatgagaacaaatagtcttgttatagtttatctggtgaagcattttaatgaggcatagctgtctgttccattaccgaacgacttttcttatgtgtgctctggtagattttcatatggctacactgaaagatattcccaaatgtctgactaataactctatctataggcaactgttctgaaggtttaaagtaaggaggatggggttcatttagaaccagtgggaaaaaatgctaatgctgggctttgaattttatggatgctgtagctgttatttttcaattaaataaatgttttatatgccatgttttgtagctatcgcagttaaactgccctcatctttttgcccagcaaaaaacccattaagatcttcactgagattgagtctaggttttttataaaattaataactttgctactggtttctcaaaaatgagtagaaatgacttttcaatgcaaatgccagtttttgatacagtgaaattatcctgtctgcagtgactatttgaacttttatcggcaattggacactgagagacttagtatatgaacagatttatccttagattatctaatacatgctttgcgccctgcaccataaaacccgatctatttttaaagccttggttgttctgaaaaatgaaatgaaattgtattaaatggcattttgactggggagaaaaaaaaaaacttcatgtggtttaagagaatggatgccggcaattgactgtctactgtttattcaaaacttatagattagcagccagatgtggcagaaagttggctgatttttcattcacaacaaaaacgatgctgtgcttaatgaatggaggtttgttatcccagtaataagtaaaaggaacatgaaagcccttgtgtttaatgttcatgcaaataagctatttgcaggtggcttttgggcagggtcaagtattttcaaatatttttcaaaactgggtcaagttttttaattgtcaaaaattaccagctagaggaaaacctcctaaaaactttattatgctatttcccaagtaaatgaaatgacaagtcacttatcatttaaaaattacatatgaaaattcttttccttatgatttcgtcaataaataaattctagaggattctagatatatttatttggcatttttttttaatgtggtatcaaattttgtggacattctttagagaatcaaattcttaaaatggcattgaacatttaatttaaaatgtccttcttgaaccatacatgtttattaaaaagttattttatataggttatccattaaaaaacaattttctatatatgtaaacatttatgataactgctcattattttggtccatacttatttatctacctatttattaaacaatacaaatcatacgctttgtaaaaataaaggcctagtctaatattactctctgtcagaaataaaataattcagagaagtctgtattagaagacaaaataaaacaaaacagaaaatgatgagaatcacaaaaccattgccaaatttccagctatggcatttactctccatgtggccttaggtatcttactctcttattttaacctttctttgattactgtaaaaataatttgttactaagaagccctcttgctttagtagctgtgagtataaaattaagaacataattctcaaaaagtgttttagtcttcctggaaacattttaaaatatcaattaatcattgaacaatacacaatcgcctgatcatttgctaagagagggttgcattctcatctctgttcacttctgtcctttctgagacttacacaggtatgagagctagaaaaaatattaatgtgtagtaattcaaaatttctcattcatgaatcacttcagcagtgcaaagaatactttgtaatttttaaaaggcatttttattaatatacttctactattctaccccaatcaacagcaaatttacctaaatcatgagactactggtacttctaatttttagaaaagaatgacataaactgctaataaacccaatgaatcctttacccgcaatgagaatgtccacgagtcagctcttctgaccctctggccagtgttctggagttactgatctccaactttctaattgaactctagcttggtatgtgagagcagccatgggtgaaccagtggagcaagatttaagccttgacattgccattaatgattcaccacctgttgcaagttcaataagttattcacacaccaaattgtggccgcagaattctgggagataaactaagttagaaagattgggggtgaataaatgtttgctaaatcagaattgttaatgatagaaatctgtatcttaacaaagttgagaaatcttgtcttcttaacgtgtatttattgacttcccaggatatgtcttagtgaggaaacatagcttctggcatttattattagagtgataaggaataataaaccacagtgcttgagagacagggaaaggcagggggagccagagacacagtaacagaagcagattaattgactgatgaaataaacttgagataagagagcacagaggaggttcaagagatggaaccatatattcctctctatctgctcccaacatcaaggaaattcatagcatattttataatgaatccctgataaatattagtctataattgaaaatctattaaaatgactatttcttagggtacacaaaaatattacaacaaaacaagtaaagaaaagttgccatgggatggaatattatattttcctgcatgtctgcttcaaggcagaatcctaatggtcatgtatgtaggtaaattattctttttacagcaacttctgggaggtggtatttggtgcagtataaaaggcaaggggtgtagtgagggtaaagcgtaagtactttgatcttgagccttgactatattggacttgggatctcggaaatcttggggataagcagtggattaaatccataaattagtaaagtgttgattatacaacaggtagaactacgtgccacttttggagggacagtcttcttttttaaaaaaaacaaaaggccttaaaggctttatgtatatataaagccttttttaattataataaatacatttttttaatgaaacaatctgcacatatacaattccactctcaagaaaggcagttatttacataattatgcagaaattcctataattatgaaaataattgcctttcttcagagtggagttgtatatgtgcagattgtttcattttaagaaaagaaatatttactgatttgattaactgaagttctggatgcttaaaaaatgattaaaatacacagatctactatctgtcttcatgaactttaaatgtcttgtaagaaattcaagtaataaagactacaacatttattatttaactggaacatgtattatttattatcctaactgtggttaggaagcaccattatttattatatctatattaatcaagttgtatcctgtaacaggtttcctgttatccactcatgtcttctaacttctgaagtattgtttaaattacaagggagaaacctagacactacattttctaggatctcaggacaatagagctccaggtgaaattatgctaaataagggcatgagtgtaagatgtggatgtcacagtgaagagatttagagcatttttctggtgacctcctgtttaggtttgacaagcatctaaaatcattgttagcaactttcccataattattgcattttcagcctttatgaaaatagcagcatttttttttcctttctttgcccatgcacaccatctaatcatgagataagtctccttctgagtccctaaatacatgacatacatagattgggatctttttctgacctgttcctgtctgatacattcttcaactctaagatgagttcatactcatcttctgaagcccctgggaaatggaaatattttttcatattggatgttggtagagacccatcatttaatgaacatttatgtgccaggatttgtacaagacacttagatacattattcatgtacctcacacaaatgtatcaacaacacaacaaaatgtctgtatgaaataataattattatatcccttatatggaaacagatccagagaggaagatacactagcatgtgtaaatagaggattcaagtattaaacatccatctgtccaactgactacaacctctttcataaaatgctaatttctctcctgcttctaattttcttatcaaaaattgtcatctattgttattgggtctatgggtgggtagtgactccttggtttccattttgttctagcggattactgtcttctttatttttgttctagtgtttattgagagtcctaattaattaacctggctgctctgacttccatcagctcaccattgtctcttctcccagctcataatttctgtaacagagctctaggctatgctgaagttctgctatatgttgccagtctctctagatccaagtgcctcttgtcggccaagtttacatgcacgtgtttaaaatcttcttattgactctatatacaaagtcttcacatgccttcctccttaaaataatagcattgtgagaagaaaaaaaaaatcatcattctttttaaaactaattcaggatgtctatgttatacaacaacaagacgtgggggaatatttacctggtagttctgtccctcgttatcattctcactcattataaaattggtatctgaaaaaaatcttgctgcaaaaacaaaaaaaaaaatgtatagggtataaagaaaaagtttgcttcacatcataaccattacccatcccattgccaaagggaagattgtacactacatgattccggggagcagcattcacatagactatagtgtgcatggtacatgcaagagaccccatagtactacccgctttgtcctccttgtagacatgctcacagatgatccatgctccctgacctggagtagtcaaataaaagagtagcatcaatttattaagattctttccagaccattttctaggtattcccattatatattccttcaaatggaaggattttattctgtacatcacatctcactgtacacatttttttctgaaatctgaaatctgagtattttaattttatacagtttcaattgtgagaagtacctgacagactgacctgacctaacactctctaagctaaaacactcataaactagcatagaagctttacacatttatccatttctctaatttacttatctattgtttcctgaaacatctattaatcttgcagttatttgagatgactgtgagcttactatttgccagggatggcatgagcaccttggtttagtctagtgcctggcatttattttcctaaactgtggcagcaagtttagctgtaagcatattttttatcagaacaatcatccatctttaactacatgtgaggaaagtactttcttatattgcattacacatttttatatggccacagaaatccttacttagtctgacaaaattatggtagatttctttctcctaaggtcaaggaaagaatcattctgtactgtttccatggagatgtttctccttttctcaattgccaattgtctactgtgtgtcctgggttccttcttttcatatgtcatgaggattctcaccccagcattctgctcctctgagtcaaagcccttgactttcacttctcaattgttttgtttgcagtttttttgctttcctttatttttcttactctataaatgctatgaaagtgtatgtaaaaatttacccatcttttagtttatatttgttatcaccctttattcatataccaaaccatataggaaatgaatataaggagatctttcttagtaggaggtagaagtaaaattttgtttagaataaaaacagaaaaaaagagaataaaattccatatcaccagtttgcttctaaatgcccaatgtttccacttatgagcttgctactgtacacaacgcaagggcttgtaaaaaattgtctaaatgatagtggttaaggacgtattttaggctaggttactttaaaaaaatatatcatcacttctgccgtcaaaagtgaatttgatgtatcataattgttaaagttgaggagggtcaaggattcttctcattctatggtttccttataaatacactttctaataaatgcctaatttttttctgtgaaattaaaccattagatattgctgaatgtctgtatgtttcttacttttctagaatctcattcttaattatagttttatatttttccttcaacaaagtcttaaaacccatgcagctggtgtctattatttacattctgtgatgtattttatttgactttgtgtttttagtcttttcacagaaatccttttattgtgatcttcttgtccaaaagcacttatttcatatctcttttccatacctatcttcattagcaggttgcatttcagtttcttcagtccttttttagataatatattttactacatctgccttcacaacactgtatacgctctgatgatcaggtctcccttctttttttttttaaaattctcgtcctctttgggacccgtgacaaagtaaaaggcagatttttttctcacctgacttaaaagtaaaaaggtggccgggcgcagtggctgatgcctgtgattccagcactttgggaggctgagaagggcggatcgcgaggtcaggagatcgagaccatcctggctaacatggtgaaacccgttctctactaaaaatacaaaaaaaaaaaaattagccgggcatggtggcgggcgcctgtagtcccagctactcgggaggctgaggcaggagaatggcgtgaacccaggaggcagagcttgcagtgagccgagatcgcgccactgcactccagcctgggagacagagtgagactccatctcaaaaaaaaaaaaaaaaaaaaaaaaaaaagaagtaaaaaggcttcatatgtttctcctctgattcttcttaggcccagcatttccaaaaacaaaatagtacacaaaacattagttgtaatgatacttcaaaaggttcaaatactagtttttggctgctttctgtctatatttttcttctaaagaaattttgttatgaagtattgaactattcagtatactttaatattttccaaataaagtttccaaactgatatttaacaatattctcttatattcaaacatattctgaactattttctgctgtgtctctagatcaatatttataaatctagattgttcatgtattttttttcctttgctaactttcaagatcatatcaaaaagcaccactgttgattccattttttatgtttcattatttgaaactatattgacatttttcctcttctttatcattccctgttatctcatctttgtgagtcttccaattaatgttttttcctttgaattatttattttttaattgaaaataaattgtatatatttaaggtgtaccacatgatgtcttaaagtatacatacattgtggaatggctaaatcaagctaaacatacgcattatatgcattaccttgtaatcggaccccttgagatgtcaatacctcagcatttttagtgattgagataacaaaaattcgaattaggcccttgcttgcttgcataaaagccaacatcccttgttctcacaatacaattgcaaactgctgatttactatttctttgtcaaccaggagaagataactttaaggtaacaaaaaacatttgcagaaggaatgaatgcctataaggatgttgcaactaactgctgaggcccagaagtctggttgctcaggatattatcagagattaaagaaacacagactttccccttggttccctaaaactccccctctcttactgtctagctgcaaaaatatcctctctgcattttttttttttttttttttttttttgagacggagtctcgctctgtggcccaggctgcagtgcagtggcgcgatctcggctcactgcaacctccgcctcccaggttcacgccattctcctgcctcagcctccctagtagctgggactacaggcgcccgccaccatgcctggctaattttttgtatttttagtagagacggggtttcaccgtgttagccgggatggtctccatctcctgacctcgtaatccgcccgcctcggtctcccaaagtgctgggattacaggcgtgagccaccgcacccggccccctctgcttcgtcttattgttaagacatgtctgagagatcttgccccgttctcactttggccaaatggaataaacttttatctatccccaagcattggtgtgtcagtgtttggtttcaactgagcatcaggtacatgagcccgaatttgggcctctacaacatcttcacctacttactatattttgtgtgtgtggtgagaatacttaaaatctactctattggcaattttcaaatataaatgtattgttattcaccgtagccaccatgatgtgcaatcaattttttgaacttactcctcctggctaactggaattgtgtgtcttttgaccgacatctctgcaatttccccatgccctagcttctgatgactaccaattaactgtctgtttctatgagttttacttatctaaactctctatataagtgagattatgtcatagttgtttttaagtgcctggcttatttcacttgacgtaaagtctcccaggttcatccgtgttgttgcagaagatttcttccctttttaaagcccattaaccttttatagatctggtactgaggcaatgcaaacttattggacaattatatgttatttgaataaattgaaacataacagcttataaagggtcaaatggcagttaatagcctaagaaataggtttggaatattatttcttagcataaaggataatactggtcagagtcttctaggcttgaattcttggctacttagattttatcaagtaaattgtaaaaggatagtcaatcacttttttcacatgaattgctgtatgaattttgatttgacaagaaagactgtgaaaacaaaaccactattatctgtgaactacctaatgtggaaagaaatatccttaaataaaactttgagaaagtagattactcaattttttccgacagatatcccatatattgtaactaattataatatttaattgaatacaaaatctttcttcttaaggaaagattttattcagttttagaacgttaaagtttctccactctaatatatacagaacttctttaacctttaaaaatattgcttcacttattactcatgataattgggccacatacataattaaaacacaccatttattatttacccttgtaaaagtggcatctggttccccaacttagcttcaaactgtaattttaaacaaataataaagtgttttgaaacattaatgtggttaattgtcttatctattgtctatgttcatcaggagctgtgacatgcgcaaaggaaggtaatcagaggaaggaagagaagaagctaagttctagagaatccattaatcatggtttagatgactgaccattttattattttccattttccatttaaaaacgttccatttttaaattggaagggggtatgttttagaatagaataacgaaattccctccatctcctcgtagtgtacgtgattaagaagaacctaacagaaacataaggttctaaggttcttgctggaaataataatcagaactgtaagaattctcttatagaaaacatttaaaaaaggaaattctagcaatagaattcattgttaaaactgtaagtcacaacaatattgtctctgcatgctgactgtactcctctgtaatcttcaaaggcaaacaggaacagtaataatcttttcatgtactcttaacttccttctctgaaaggctagaaaatgtcttatatgtagcactcatactgtcatttaatcaaacccagtttctgtttttcttcaatttctaggggaatggctacttagtctttctggcataatgtgaatttcttaagtgtctgtagactacatctcctatttttacttcttgaagtttctctcaaactgtgataaagagtgtcactctatcggtactgttaacaatgtaaattttgtttctctttttgttactgccaagattccactgactgttgaaatataaaagaaaaacagcattaaatcaggtgtgataaaatcacctttttctgtttatctccaccactggcatttattggcacttggaaactatttataaactcatactcttgtaacagtcttgtaactgaaacccactggattcaaaatctattcctagtacttaactttcttctgaaaattccctcatctataaatttgaggatgatgataattgcaaagatgccagggaaatttataatcattattgaactaatccttttgaaaatataaagcagcattaaatgttacgattactaatctttttaattaaagtggcaaatgtgtccaaaaatctgtaactaagttcattactctcatttatgcagctaaacttaagttctaccaaatgtatttttaagttgattaaaaatatggttggcagcatttataaatacccattattaacatgctatactggtaaatatatttctgctcttatgactagagagtgttgtactttagtaaaaaacttatacctcaataattatctgctctcctatttttattttatttgcaatagatatgtatttattcatgcatttgtattcttattgaatgaaggatgttatgtcacttgcattgagtacataggcatccctttcgacaaataaaatcagaatctaaactacagaaccaggttcaagtggggacagaagtacaattttaataaaggtcaaagttttgctagtgtttcacttaaaatttatttttaggctttctgaatgttctcttaaagaaaaagacttaatcatatacgtaccttttttgtattgttaacaaggaagaaacatactaatatgaatggtactacatacattatacatgttatacaagagaagaaaattatatattcaagataaacatttttataatcacaatacttcaacataaatgtgttcaatatagtaaagatgcaggttgtataatttgtcaagcaaattctcaattatgtttgaattctatttaaaatcaacattagtattgacaatattcatatttaaggctttttaattatttaaataggttcaagtttgctgtgttcagcattattagttgtaaaagtaggctctggtaccgaaaatatatatttttagctcccttctgtcagtctttccattaaatgctataggctcacagttttacatgcctctcagcacctcactgctcttgttgcctataatattttattagtttaatccttctgaaataatcctggtcattcaaaaccaatacatcaaaatcttctagagtgaacaaaagaaaaaacatttgtgaagattaaaagaaaaaggagacttctcagatatattaactttaaagactatatctcacaattatgtaatatatttgttgctttatctaattagatttgcatttcttatatataccatgcatataaaaatatatttgatacaaattataatacaaggcattcaaaaatagaccattataataacagaacattttctaaagggattttaaaactgtaagccaaatgccttaatctaatactacttctaaaatgtattctaaagaaataatcttgcatgtgtggttagacttaattacagaaatattcattgtaacctttctttagaagtgaatattgaaaactgaaataaatctaaatgtccaactttataattgctagttatggaatactaacaaatgaaatccatgcttttaaaatagcatttagtgaagcaaatatatgttcaaaatacatataaaggaaaaactggtatgttattaaagaagatagaataaaatttattttgagagtgtatgctaataagacagttttgatatttaggaaaattaaaatgttaggtaatattttaaataaaaaaataaattttctgtttgctgagattatacgtattttaaacaatttttaatgtacgctatagacactgaacatgtataatttatgtatcaagaaaaaaatcaataagttcaatttttaaaatcaaaattaaaagtcacataatagatcagagaagataaagatgaattacacttttttctttatctaacaaaagagagtgcatggtttatggagacagacaatttttttctctggttttaactctaagatataaaaggaatctattgtatacatctggaaataagaggtatttaatacctaatgtatattaagattactgttttagctttttttttacaatatagaagtactgtgtgatgacttaccttatcaaccattgaaagagccattttcaaagattgattaaaatcgaagagttccataagcaattttcactaaagcattgaaaactattatccaagattaagaaaatacttttctagggatccctcatatctagggatctaatgaccattagatccaccttgtataatggaattaggacaacccaaagatctggatgattgaattgtcatttggggattattaccatcatacagctcagtttatggcaatttctatacatgtgtttagtattaattgaaggaaactcataggaattagatgccagacatgaagactatatacatatcttcagagcgcttgtgtcctaaactgaaaagtgtgttttaagagtctgggatatgaaaccaccttttctctattcttgtcaaatccatgtcattctagctactgacataatttatgcaatataaatacaaataatgataagcaaagttatatgaaaatatgtttccagtatataggtagttttaaccattctttttagaagaaatgtgtgtgtgtgtaaatgtcttaattgttaaaatgattaagtcattcacaggtttgttaaagtttttccatgtagctggagtgataataatttgtattacattttagagtggtttgatgcaaataaataagaaccaactcaaaatgttattgaggttaaactccaagaagacaaaaggaaaactaaaataacaaattaaactataattaaaacatttcaactaagaaaaaagtaaaaagttaagctatctcagacaatgttcgagattgaagcttgttaattgcaatggaaaaactgctaattaccacaaatagtaatttagaggcataaatattacacaggtgtggctgcaggaagttgatattaatcaaacacatttggcattttcaatgttgcaaaaattacaattgtaaacaccttccatacaatcaaatgttatgtgaattttaaatgagtctcaataaattatactgcataaaaacaggatttttactatggatcataattgttaatgtcttccgtactcaaggttgaaatataaatcaattcactctattatttggtttggaagtttaagaggacaattcacatttcctttgatacactctaccagtgtcactggactggtgatgtgacaagaaaggtcttctgtagaattgaattgcaataatatggagattataacaaaattatatatgtacctaagaatattgactttaaaagccttcttcagattgcaacattgatttccagatctgttgggaactagctgccttacttaatgtaacagtcttggcaatggaataatcatatatatcacctatggataattaatttttaatcattgaaattcactgaaatatgttgaacatgaaaatcatacaaatataattttgtatgctgtttcagattctttggaattttattctaagcatcaatcaagatggtatagtacgagaaaggtagaacatgtaattataaattcaggattcaggaagtttatttttctcttctttttaattctctcaaaatgatcttgattcctgcaaagtgttagtatatctggtaagtaagagtctatttcttttaaacttcatctgtattaaccagctttatatgaccaaaatgtcccccaaatttaaatctttgcacagtaaggccttatatgtacacctggcctcatttcaaaagactaaagcagttgttctcaaattcagctgcacattaatataaactggaaaactgtttaagctcctgatgacaaagccacatgtgagactaatttatgctgaatcactgggccaaggacccaggtatcagcattttttaaaactatagaggaataaccagggttgagaaccactgcacaaaatggtaaatgcaacttttatttaagttattttttttaaataaataatggttgaattgatactgatcttagtaccaagtcatggcaattttttcagacttagagaattcatcctggcattgagattattaaagaacctagaaatccaagtgtttttgtttatatttttcctgtaaatattagagtatgctagtgctcatccttatttgataattttggaaaatatattaaacatttgagattgaatatcaaaaatctctaaaagaattttagaaataccattcttctatgaaataagtaagctcaatcaagatacatattatagtgcccatttaagaaagtctaataataatgcttgcactgcttaaagattaggttgataaattaattattgttaatcctacttacataatcaacggacacctagggatggagtcttaagtacagacacagaagttgaatacttttaagaacttttaaatttacatccgggttaaattttactttaaaattatgttgagtggttgtgattagtacatgtgtgattagaaccgtctttctcaggttattatatcaccatatagacacaggaaaaataatagaattaaaaataaagcaagaaaaataatgtgacactttattggcttcagataattattttgagatcctaatcctaccaaaacattctgcttttcttaacttgatcctacttttgtttgtttgttttaataaaggatgaaccaatatcctgagaaattttcaaatagggctggttataacactaagaacctagatctcactatgttttagaaaaattgtaaagtatttcaaataatcagtaaagtttcagctctgcaccattgtgtctttgcaatatggggaaagtcacttcacttctctccctctctcgtttttggcacatgtaaggcagagaaaataatatctactccagctatcccacatgttattataaaatataataagagatagaaaatcactttataatgttcaaagtattataaaagtaagccatgattatatgtgggattaacagcagtttgttatttaccatttaatgtatttctaatgtacatttttgccatatttaaaaatgtttacatttcgatttttaagtgaaagagtaacggtatgacattatgccatgttatatctgatgccattatgtcaaacaaacaaacaaaagcattttaaactatttggaatcttaccaaaataaatcttataactatgataatacaggtttttgaggatttcgtttgtacgcaaaaacagaggcaataaaggcaaaaatagataaacaggattacttagaattataaaccttgtgcagagcaaaggaaacaggagggtggagggtggagaggcaacctacaaactgggagaaaatatttgcaaaccttatatttcaatgtactagtgactatcaccctaataactagtcatgggagcactgtcatgcatttggtatgtttttgttttcgggatgctgccacttaccacggcgggagcctgatccctgcggaatcgactgtagctggacttatcttgaatattctgagccaacataccaaaccataaggtgctaattcattcatgcttgaaggccataataatcaatacacattcacgcacacatgtacgttcacgcacacgtacgttctcacacacccgtacgttcacacacacacgtacgttcacgcagtatttaaaggagtgcttccgattaaatccgcagatctgccctccccccatctctgagtttattgttaaattaggtaagccagcccccaaaaacaagatacttaaattgaacctagtcagagccctaaaaatcataatttaaccatgaacactccaaccctagcccctcgattaacgtaattttctaaaaaatcctaacattctccaaccaaataaaatctcctatttcgatgctaactaaatctctgtcctaatacttatataatacttcaggtatcccgctctgaaaagcttgtatcccagatattatagtcctaaatcaaatataacttcaactacaaatggcccctcagcgaaaacctctgctagttcaacttttttaaaggccctaaacttccaggactgtaaaggaccactttagatttatacctaacaagatcctaccccctgacatccccctagtatttcaaaataccactcaaatgtttttcacccagttaatgtagcttaattatttaaagcaaggcactgaaaatgcctagatgggtccgcacaacccggtaaacatagaagtttggtcctggcctgttttttgaattcttagtaaaaaattacacatgcaagcatccccgccccagtgagaatgccctccagatcacctggatcgaagggagcaggtatcaagcacgcataaacgcagctcaaaacactttgctcaaccacacccccatgggaaaaagcagtgataaattttaagtaataagtgaaagtatgactaaactatactaatatttatggttggtaaattttgtgccagccacagcggccatacgataaacccaagctaataaaactcggcataaagagtgtttaaggtctacattcagtaaagctaagctccatctaagtggtaaaaaactccagctgaaataaaacgattacgctccttgaggataagatgcatattgtaacaattttctatatcctccacaatgttttgcagattcaataactatttaatgaattgagttaaatttgcctatactcttacgctcataaataaccttctaattctcaattcctctaaaacatagaaaaaattgccaatataaaaaagcaagaaagaagatattaaccattttgtcattcaaaatatgactcattcttatacaactacctttgtcagcattcttgccattggactatctagactttgacgctggtatatcatggcttgttgttagagaaggtaaagtttggaaaacagaagcagttatgtaaagcaatcttagaaaatccttgagtttcccttagaattttgtgtcttctacatgttttctgtttcacatagattcagtttgcagagttatgtcataatttcatgagcgtatctgtcagagagccctttgaaggcctatttaatccaactaagaccattttttattgttttaataccattgaacttgttctgataattgaggaaaaagagaaagacattccatataatacaccagatgcctaagtgctttggatagtcataagccttttctcctatagcttcctatttagaaatgcctgctcttcagagttttcttaagctttccaacttgctccttccattttataagaataatagtctatttaggaagactattatcaaataaaaatcagaatgatcagtggacacctattttagccttgggatttatatcacaattccctaagactttatatttccagaaaagaaattcaaactaaaggtcacaattactattattatagtaatactgataagatgtgcattttaactaaaagaagttcccactatttttttttctttctacttttcaataatccttgggaccttagtaggagtgtgcagtagtcttgtggtgtatttttagtttaaaagtctgagcatacctaattaccacttggtagatattgttcaaactcacttttgaatccaagtgtttttaccctcatagaattttttttaaaacgagtatttgcttgtttctattatactgtaactattggagctactaggaggccttttaaatttcaccaacaagtaggcagaatggagactaactgaagggttgatgggcttaaagaaaataaataacctaacaaaaccaccaggctaatggcaaaaccaacattaggaaccaagtcactttacttgggattagtggataccaaaatgtgctttctcggaagcagcactttacaaggaaatacggaaatccacctttgttgtccttcagctaaagggaataaaatcatgtactttctataattttaaccctgttataacagatgctacatgaactcaagtggaactctgactgccttgagagctgaataaaatgcatcccaccatccgttgcagccgcatcaaggtattaaaaagagagacagaaggaagaggtgagagaggcacaagttcaacagtgtgaggcagtcagacacaatgggagggagaaagaaataaatgtctgaatgtcattgaaagaagagacaatgaaggcatatgtaagagtcctgctaaagctatggaacctcaggagcctatttgtaagaactacaatttagaatagggaacttgcaatacaatgcctgacctttatttcctttcctgcctcgaacttgtgaaaacctttgattgacttttctatgaacatgaattactgttacaatatttagttgaacaatatgaatttctcaaagcagtaatacagcgctacagcatagcttaacattgtttaagtaatatggtttgcttatatttaagtcatttctaagggacccatgcaaacacagtcaggagatctatttctgatgtatttccaaggctagaaacaaaaaaatgctgttaatgcataaacagtcaaaaaaccatgcactgtggttttacagggacctctatttctaaagatgattgttgcatgagggtctctgcctttatgaagggaaatgtgtagattttaactagatctgtttgtgttttgaaaaagaaaatcatgtttctgcactaaaaaataaattcctaatcaaacctttaaagttaacatttagaacagggacagaaacttctgttgtttcctaagtgttttgctgttgttcctgtttagttttaaatcattttttagaagttttattgaggtataaaaaaattgtacacctttcatatattcacctggatgagtttggaccaatatcatcatcacaaccaaggtactgaacatacttattcacctccaaaaattttcttgtgttcttttttaatggtggtagtatatttttaagaattcagcctttgagcagggtacgaaggaccttcaacaacaaatgcaaaagtaaatgagctaagttcatataaagggttagctctcagtgagatattcaagttatgatcatatcctcaagaggcttgtaaactgactgtgggtttccagtttggttattcacagataggccttcatttgctcattcacctattcattcatatagccactcattcattctcaagaagaggtatttgtccatatctcaccatgtggatgagcagatggtcagttctcacttcttttgccattaagtgtgctcaccgttgagctccaggatgatattttctctcactttgcgtcattaccaaagtggctatcaagattccctcccctaccttctttttcttttttcaatgtttaagagctggagttaatttcttgactcctttggtaacacatgccgatatataccactcaaggcctgttggattaaactgttaaatttgtcatctagctaatgttttctcagaaccagacaaattaaacagagtcaattgttgaaattatttcaaaagataaacaatcatagaatggaaataaactacagaaagtagggaacaggagtaactaagtctcctagaaaacatttgcagcagatgttaagtatccagtctcgttgttataaatgaatttcaaagaatctcatgaggagcagctttacaaaattttactgcactaacaaatggcagccaatctctgtagtaaacacaaaatactgtaacatcctttgtatctccttaaattaagccaatttctgcttacacagaaaatctgtctgtggaaaacactgcttagaatttgaaagcacattaatctggaagccacaacagaagtgtgcttcagaaaacttcttaatatttttcttgtgagttattctctttacgcttttcacattacaatattaccaagttatcataatgtattttctgcactcccagagcaagataagactctagtagttgctgggaactatgcattgtctaaatatgggttcacattctctcacagtgattctggaatcatacacacaaatgagatcactgctgtcagatcactgggattaagactcaacctctctactcactggccatgtaaatatagatacagtactcagatcctctgaggcttagctaattatcagttgatttggtctacacttaccacattaattatttgaaaggattcgttgatataacatgtgctgacaaccataatcattattaaggcaatgtttaccaatatgtgactttaaaacagatactactattagataacaattcacactatacattcaatatttaaacaacagaattataattttgtgaagcaaattttgtactcaaacagaaaatccaattctataattattttctgcaatattgggtcatagaaccaacaaagaatatatgactggcttagacgtatgtaattacttatgcaattagtaataaaattcttcactcattcctagatttgaatccctgatgctctgcgtagcagctgtatagtcttggacaagttgcttaatctgtctgtacctcgatttcctcatttgtacttcaattttcttatgtggtaaatataaaattacttaactcagagctatgaggtcagttttatttgagagaatccagaataaaatacttagcacacatttcctaccattcagcatgcataatacgtactcaaggaaattttagatctctgtacatgattaatatattaaatcctcaaaccgactataatgtctgaaaatgcatgtctttatgtcactgtacctctcactgcacttggcacagtgttgtgaatatatttgtcatttgtatgttctttctaccatacaattctgccactccaattagcatattgtgttggaaaacaattgggtgcttgccttatgttttactaaatttatacggaactacgttgacacttccttgcccttcagatgctggcactcactggttgctttctagttctcaggagtctctgtgtgactctgtcctttacacttgccctgcaacatcaccctcagccctagacaaagccaacatcatttttaaaaacctgcaaatatgtctgcaattcactgtatgaatattctcattctatcaaaaccctgacctcactaactcaatggagcaatacaggatgagaaagtagtttatatgaaagtcatagaaagcttgctttgtttattcatccaaacgtatgtttttaaaggacgaggcttttatctgaaacaaataaaattataatttgaaatttcaaataatgtgactaatatattatgaattcatttccaaatatagaaataattaaaacacttggggtatagaaaaatgagtgctgtatctattcttttcttatattaattttaccccagctgccagaatttagttttttgtttttgttttttttctttttctttttttgagaccgagtctcgctctgtcgcccaggctggagtgcagtggcgctatctctccgctcactgcaagctccgcctcccgggttcacaccattctcctgcctcagcctcccgagcagctgggaccacaggcgcctgctaccacgcccggctaattattattattattattttttttttttttttgagacggagtctagctctttcgcccaggccggagtgcagtggcgccatctccgctcactgcaagcttcgcctcccgggttcacgccattctcctgcctcggcctccctagtagctgggactataggcgcccgccaccgcgcccggctaattttttgtgtgtgtttttagtagagacggggtttcaccgtgttcgccaggatggtctcgatctcctgacctcgtgatccgcccgcctcggcctcccaaagtgctgggattacaggcatgagccaccgcgcctagcgcaaagatgtattttactaataccacagaggtataatctgctgctacttcttgatcaggagtaaacaagtttacttcacagcagttgatctaattttcttccccattcattcaatggtattttttttattgttatagaacatactgaattggataataagtccttttctttttcttttttcagaaatggtttctactctgttgctgaggctggagtgcagtggcattatctcgactcactgcagcctctgcctcctgggctcaagaaatccttcgacctcagcctcccgagtagctgggactacaggtgagcaccaccatgtccacctatataatttttgtattttttttttttttttgtagagacagggtttcactgtgttgcctaggttggtctcaatctcctgggttcacaccatcctcctccctcatcatcccaaaattctgggattacaggtgtaagccactgcacccagctgagaaggctttttattataggttgttcttattgttttatttagttggtttacttgttggttttcaaggtaagtttgacatataaggtggtataatgtttaaaggtcaagttatagagatagctagattgaagttcaaatccagagccaagttacttagactctctaaggacttgttttttcccttataaaattaaaataaagtggatagccacttcataggtttgtaataagaattaatatgatcatgatgtcacagagttgcaaagagatactgaaacttggctctgccaaaaaatattagctattgccattatgattgttctccttaatacctaaggcatttgctgacagtcaggttactcatcatgtccttccaggaaaaaaactttaagaatgttgaaaacttaggaactacttttaaaatttaattttcagacctgacataacacagctgaggaagagaggtggtagctgattggggatagatgtagagatcattaatggtataagagtgtgagaatgtgaagcaggataggatatgatattactcatacagatcacaaatacatgtcaaaattatatttatcattcatttaagtaaaattcaacattgttttcttcaaagaagaaattgcgcatttcactctatctatttaactctggaaaattttacaaattgagcatgccattttttagtatgaattcctttatttcagctgccctgctaactttggcatgatgagcagagaaaaaataaacagaatgattagttctgaaatatgaaaaagtgtctaagaaaaggagtagtcttgagaagtagggaacaggatgaagtcactaggggacagaagggtaggagggagtgggaccagacaaacactgagctctgcatgcacacgtaacagtctaaaatagtcatccagcacgcagactctaagtcaagataaccaagatgaattgccaacttctccacaagcaatatgactttgggtaaggtatttgagttttctgtgtcttagtttcttcaactgataaataaaaatgatggtcatatctacttcataaaattgtgataattgattaatacatgtaatgaatagcgtttggcatttagcttaataataagacttttcattaaaatattagctacttttgttagctagcaactctcagttttgcctaaagctgaccccatatctagggtgaggttttgaaagaaattcaacaccatcagaagtaggtctggaagttataaaggaaagcttaaagaaacagaaatatgtgcaacacctatttacaaagaatccattgggaaaaccccattgagcccagggagatggcacatgtcccctttggttatggaattcagttccctgacggtcagtatactgtctttgttcccaaggcaaactttttaataattgtgatcccactcaatagtcatgttcacttactttatgggtacatttgtggcatattttaaaatgtgaagttgagtgcatttcacctgaaaaccaaaggcatgtaatgacaacatgctatagaggaaaaattattgatttgtgtaaataggcagatcttgtttgtattctagctccatcacttactaattttgtgatatgggcaatttatatcctatctgagcctgtgtttcctctacaatatgaggtaatttctactttgaagtattgttatgagggttaaatataaattactttctggtttatgatgttggtatatactacttctatgcacaaccgttatttttatgaataagattttaacagtaagccacagaaaatataatgtaagactgattcttagaatctatcaaaacaggttgtaaaaatgacttaaacatctagcatggcagtgactaacattttgaaaagcttaatttttccattaagaactatagcccaacacagtgtctgtgcttcagtgttcctcttatcaggaaggataatatgtgtgatgcatggactaactctaatgaaaatttttattcttaagacacaaaatatttcccagcacagtacataaggtctttgtgcttatgtcagcattggagataaatttctgggaaagaagtagagaaactgctcatttctatagacatcaaaacaccaaagtagccgggcgcggtcactcatgcctgtaatcccagcactttgggaggccgaggcgggcagatcacctgaggtcaggagttcaagaccagcctcaacatggagaaaccccgtctctactaaaagcacaaaaaattagccgggcatggtggtgcatgcctgtaatcccagctactcgggaggctgaggcagaagaattgcttgaacctgggaggtggaggttgcagtgagccgagatcgtgccattgcactccagcctgggcaacaagagcaaaactctgtctcaaaaaacaaaacaaaaaaaacaaccaaagtaaaagtgaaaataaaggtacacagcagactttttctttttaaatacctaaactgaaaagtatacctgtcaagaaacatccaactcatgaattactttaaatatgtttttaaaacagcgtgcttgttttataacaatagattcatgctagttatctgatattccccagtggttgctttgtggagctcagtgtcatccttggagaacatgggcaataaaaagcatttcttctgcaccagtaagacaaaaacaaactgactacttctcacataaaccttggagggcttccctcagtggggttagtgatcagcaaatcatgtcaaataaccccttttgttatttttgacataatagtgttcctagcagacagtactcaagaattcccagattcttagctgtaacataaatttaatatactctcttttattaaaagtcaagctgtttattcacagtagctcttaggtctacgtttcattttacacatatatgtggatgtaatagctttttccttagaacttttaaaaaatagaattcagtaaaagtcctatatttgtattttctatgtgtcaagaacagataagcatcattaatgtgaaccaaatttcaattgaggagctgaaattaggaagaattgaaaaacacctgaaataaatcttcaagtaataaaggggaaagtttactttagaattagtgtatcaaaaatgagaaaattggctgggcgcagtggctcacgcctgtaatcccagcactttgggaggctgaggcatgcagatcacctgaggtcaggagttcaagacctgcctggccaacatggtgaaaccctgtctccactaaaaatacaaaaattagccgggcatggttgtacatgcctgtggtcccagctactcgggaggctgaggcaggagaaccgcttgaaccccagaggcagaggttgcagtgagccgagatcacaccactgcactcgaaactcggtgacagagcgagactccataaaaatcaatcaatcaatcaatcaatcaatcaataaaactttttaaaaagtcattgcattatttttaaaaaattaatagtttcaaaatgtatacatgtaaaatctaactgggaatactttgtatctacttgtagcacaagattaaatttattttcaattactaggagatttgcacaatagagtatatatttactttaatctgtatgactaaaagcctcattgtcaatgtgactatgtcatcattatcacattcatgaatctcctgattataacctgcacagatggtctacctacagggctctgggataagaaacttgctgtctgtctacagaggaagccgttttcacttccagatagttctgaatatttgcaagtacttgctgatttagagtcaaattatgtcttgctgtaacatccatgttactgaacttacatttgagataaaccaagattagactaaaccatgccttcaaatgacactctcaaaaatgtgatgcaatttatgtgccaaaactatcctatcttgccattttcctccattttttaggaaaagcatggtcctagttttgttagccacagttgacactactattttaaatcactatgtcatttgtatatcctacatttgaacactctttagtgtcttcaagttaaaatatgcataaaaactgcacgtccaggatactctacctggagaaaaacatagctctcattaaccttgtccagacattaaacttataagagaaaaatcattattttcctgtaaccaaattattccgctaaatttgtttttaggcaggattaataaacctttactgtaaagggaaagaggctaagattttaggttttgtgggccatataatctctatacaactgttcaactctgctgttgcagtgagaaagcatttatagacaatacgcaaatgaatgagtgtgtccatgctgcaataaaatttaatttattgcagtctattggctggatatggcctgcaggccataatttgccaacccttggttgacagtatagctagctaaacactgcttgttgtagtaaaatcttgctttttaaaacgtatgtctctcatcctagtattgtcattacgtgtgtgtggtttattgttaaatatgtaatatttaagggtctttcctatttagttttattaactaaaagctgtttcataattgtaatgcacagacatctatataggtttttattttatcattcaacctattagctaatccttagagttgtttcatttttcatgtgtttgacagatgaacatgtctaaaacactgatgataatgttaccagaatataaacaaaaatgaaattttcaggttaaaaccattttgttagtaatatgtaagtatatcaattaaccattaaataatttaccaaattattccattacctaatccatattgctccttcttgtccacaagaatatagtaaggtacatgtcaaatacatacctctgactttagtgggcatttaatgtattattagaggatcctgatatctgtctttcttaaagaaattaaactcatccctagtgattatactttcttcatctaacactataatattaataacatttgaaaaaataatgtctaataattaacactagatttagagtatttttagacaattttctaaaattatctgaaaaatttgaccagaatcattgtaaaattcacatctgagcttatgaaagcccactttattccactctaaaagaacaaaattttgtacctttaattttatcttttaaaatgttttaacataaaggtagtgggagacgttactaaaggaagcttaggtagtaacgtatttgtcgtctcagttaacacaaagaccatagatggggcagatctgcaggatgcaaaaactttcctttttctcacctcatagtagtcatatggctactgcaattctctggtttcatgtgcttacaaaatgtcctttagttaaaaataaaaagaaagagaaagagaaagacaaagaaagaaaaagaaagagaaagaagaagaaaagagaaaaaataatttcttcatgtgtctatttaaattaacaaagacgtgaattgtcccagacctccctgtgatgagtaacttcatgtgtcagttttactgggctaagggttgcccacatggctgataaaacattatttctgagtatgtctgtgtttccagagaaattagcatttgaataggtagactgagtgaagaggatcatcctcaccaatatctatgggcatccttcaatctattcagagcccaaataaaacaaaaaggcagaggaagggcgaatttaatctgtcttcttgagctgggacatccatcttctcttatcctctgatattggaacacctggttctcagacttttgggcttaggttgaactatatcactaactttcctgggcctccatcatgcaggcaggagattgtggaatttctcagtctcgacatccttgtgagccaattcctcccaagaattatcttcttctagctatctctgtctctttctctatctatttcatctgtaaaagtatctgtatctctgtgtcatctatatctgtatcatctgtatctttatctcatctgtctctatctctatctctacctctatgtctacatctgtcttagttatctatctcatttatggttctgtttctctggagaaccttaactaatatagtccttatcttacaactcacttgccagcttaccatgattataaccaagttgatcacttcaaaagaatactaaataatatatattgtttacactaagagatagctagctactctcctcaagctgaatctggcccccacctcacttagtagagcaagcaaactaaatgtagattatacattttttactcattgaaaaaacccaaataataacttatgacatgctaaaatttaaattttgatatacaaataaaattttattagaacacaattatatttattcatttacatttacattatttgtctatggctacttttacactaatgcagcagagtttgttagttgagacagaaacaggccaataaagaccaacatttttacaatatgaccctttaaaaaaaaatggacccttggtttagactgatcaataatcctatgggaggattttaatgattttcatctgtaaccaaccaagcacattttttttcttggctaggataaatttagaacatctatgtccttccctaaaatagccccacatacttgaaagtctgattctctcataactatatttttttctctgctgttaaaatttgaactcattctcttcagaaataaagaaagtaacaaaatagaaactaagcagtcccatttttattttgccatttatgagggcctatgccacctagcggtgatttagtatgtatttaacaaccagttcactgagaaaaactgctgtatttttagtttgcttaatttagtggtgttgaatatttcctctatgaccaattttggcttacgaatatgatttctttgaatgcaaagttgggaggagatgagcactgtgtgctcctatgaggagttccatctggctcaaacataaacactattaacatcactttgctctagacatgtgattctctttcataatgcttcttgcattaactgcaatataaaagttacaatccttattatttttgaaaaactcaatttgtataggactcttgataatattttaatatgtatacattttataataatttttattgatattttttcttcttttatacttttttttgtttatttatatagtttgttttcacattaaatgggagaaatactgacattgttcaattcacacccagggaaattctgtgtgaatgatatcatattatatttcttttaatgctctaaacaatgttgtgaggtaagtgttatctctgatttgcatatgaagaaacatattccgagattaaaaaattgcccagtttcacacaaggaataaattggagcacaggagttctatatagatagacctgtatgacttcacagagtgaaatggacagataaacaattcactttccaggagaaatcacaggacaatggatatcagaagaaatgatgggaccagggtaatattggatgttttgtatataaaaaactaatgtgggcaacaaaaaagcatataaagtcactgaagcaaaatatatataatatatattgcgaaatctaaaagaaaatatgctattggtaggccatggctacattataaaaaacatttcatttcacataaagtatgaatactacactatgactatgagttaatattaaaatttgaccacataggaaataggagaaaaaagtaacaacactgtggaaagcaaagaaaatgactgcaagatgaagctatcaccaccatctcgtggccacatacggacttcctcagaagcttagatgaataaagggaagagactggagttattaaaatttgtaaactcagagtaaaagccttcctgagctgaggctagacctctgagggagagatatgttccaactgctgctgttacctctgaagaggcactttctggggctctgaaaaaattggtaaactgaaacaattactgctcctagggcaaggggatgttcttgggagaatatcagcaaggacggcaaacaaacaggaaaaggagatctattcttccattctcttgcctatgtttctctagtacctcccaatagcagaacgtagcaggatcccacttgaaggaacttggaaaacgtagcttgctgatccccatcacggcatcatagcaaatttatttcagagaaatgtggctaaagatcaagattattagtaaatcaatttttttacctaatttttaatctgtattgatttcttataacataaatatctgtggttacagagacctcagtattttctttttcttctgtagcagcatttcaatcttttttgaagttctacctctctttcacttctagttcacaccatgtgagaacaatggacctaatcatcatgggcagtggtcataatatgtctcaacctgcccaaaataaagatgctaccccattaaccatatgttttattttgtaatacgatcatgatccaacctagtctaatgagaaacttaactagaaattttgttggaattattgaggaaaacagtgttcattttctgaaaaagtagcttagctagtaagatataagctcagtgctactagtggccatcttgatgtggaacaatactgagaatatttcttcaggtaatcctacaagaaatgtgtgcaaaacagaaaagaggaagttacaatgagaaatttcttacgtactatattcagtagagcctcagggtagctctaaatctagatacttaataagaatactactgataataaataatactcatatagcaaatactatgtgctaagcattctttcatgtactttataagattaatatatctaatacaaggactgtatgagatagatattattgtccagttttattatgtcctgcaaataaaatgccctgacaaattatattctctcaatcatctttcctttgtttgcaatcaacattttatatgtattcacttattatgtatcactcctttgattcctcaaaatttatttagggctatataaatattttgctactactggaattagcaaaactttaaggttaaattttcaaacatgttattgccctcatcatactgtagcaagaattagtaatcaatgatacataaaccctatttatttatccgaattattccatttcacatcctcacaaaggacactattctgtcaccatttaacccttgtccccaaaatctcctcataaatgcagtttcaaaaacagcaaatagataaattggactttattaaaattaaatttttttttttggtgaaatggagtcttgctctgttgcccaggctggagtcagtggtgccatcttggttcactgcaacctctgcctcctgggttcaagcgattctcctgtctcagtctcccaagtagctgggactacaggcacgcaccaccacgcccggctaatttttgtattattagaagagatggggtttcaccatattggccaggctggtctcgaactcctgacctcgtgatctgcccaccgtggcctcccaacgtgctgggattacaggcatcagccactgcgcctggcccttaaaattaaaaaaatttttttaaagtttttatttttttgagacagggtctcatcatgttgcccaggctggagtacagtggcgccatcatggctcactgcagtttcaacctctctagactcgagcggtcctcccacctcagccttctgagtagctgggactgtaggcatgtgccaccacatcccagtaagttttgtattttttgtattataggaattggggccaggcacagtgctcactcctgtaatcccaacactttgggaggccaaagtagatggatcacttgaggtcaggagttcgagaccagtctggccaacatggtgaaatcccctctctactacaaatacaaaaattagctgggcatggtggcacgcgcctgtaatcccaactacttgagaggctgaggcacgagaatctcttgagtctgggaggtggaggttgtagtgagctgagaccatgccactgcaccccagcctggttgacagggcaagtctgtctcaaaaaaaaaaaaaaaaagaaagaaagaagtggggtttcaccatgttgcctagactggtcttgaattcctgggctcaagcaacctgcctgccttggcctcccaaagtgctgggattacaggtgtgagccactgcacctggccaaaattaaaaacttctatgtttcaaaggacatcattaagaaagtgaaaagacaacctacagaatgggattaaatatttgcaaattgtgtatctgttaagggtctagtatttagaatatgtaaagaactatcacagctccataagaaaaaagcaaataatccaattgaaacaatgggcaggccaggtgtggtggctcacgcctgtaatcccagcactttgggaggccaaggtgggcggatcacgaggtcaggagatcgagaccatcctggctaacatggtgaaaccccgtctctactaaaaatagaaaaaaattagctgggtgtagtggcgggtgcctgtagtcccagctactcgggaggctgaggcaggagaatggtttaaacccaggaggctgcagttgcagtgagtggagatcgcaccactgcactccagcctgggcgacagagcgagactccgtctcaaaaaaaaaaaaagggcaaagaatttgaagagatatttctccaaagaaaatgtgcaaatggccaaataaacacatgaaatacacacatgaaaaggtgttgaaatcattattcattagggaaatgcaaataaaaatcacagtgaggccaggtgtggtggctcattgcctataatcccagcactttgagagactgagtcaggaagatcacttgagcccagaagttagagaccagcctgggcaacatagggagataggcgtggtttgtgcctgtagttccagctagtcgagaagctgaggtgggaggatctgcttgagcctgtgccgtcgaggctgcagtgagcagtgatggtgccactgcactccagcctgggcggcagagcaagaccctgtctctaaaataataatgataataataataataatagagataccaattcacacccactagaatgactataataacttaaaaaaaatctcaaaaaaaaaaaaaacccaaaaaacaaaaccccaacaactgttggtgaggatgtggagaaatgggaaccctataagggttccttacttatagagatgtaaaatgatacagatgctatgggaaacagtctggcagttcctcaaaaagttaaacatacagttgccatatgacacagcagttccattcctaggtcatcccaagagaaatgacaacatatgtccatacaaatacttgtacatgagtgttaatagcaacaatattcataattgtaaaagagtgggaacaacctaaatgtagatcagctgatgaatggataaacaatacgtggtccagctgggtgtggtggcacacacctgaaatcccagcgctttggaaggccgaggcaggtggatcacctgaggttggaagtttaagaccagcctgaccaacatggagaaaccccatctctactaaaaatacaaaattagccgaacatggtggcttatgcctgtaattccagctacttgggaggctgaggcaggagaatcgcttgaacctgggaggtagaggttgcagtgagccgagatcatgccattgcactccagcctggtcaataagagcgaaactttgtctcaaaaaacaaaacaaaacaaaaacaaaaaccagtatgtggtccatccatacaatggagtattattcagccacaagaaggagtgaagtacagattcatgctgcaacatggataaaccttaaaaacattatgctgagtgaaagaagccacgaaagatcacatatggtatgatcccacttatatgaaatgtttagaacaggaaatccatagagatagaaaagagatcaatggtttctaggagatggggagggaggcaattgggaatgactgttaataggtatggggttctttttaggtgatagaaatgttctggaattagtgtagatggttgcaaaatgtgaatacgctaaaactactgaattgtatactttgaaatggtaaattgtatgctatgtgaattttatctcaattaaaaaaaagtataggccgagtgcagtggctgaagcctgtaatcccaggctttgggaggccgaggcgagtggatcacttgaggccaggagttcgagaacagcctggccaacatggtgaaaacccatctctattaaaaaaacaaaaattggctgggcgtgttggtacatgcctgtcatcccagctactggggaggctgaggcacgagaattatttgaatccaggaggtagaggttgcagtgagccaaggtcacaccactgccctccagcctggtcaacagaacgagactgtcttgaaaaaaaaaagataaattatggtatttgctttggaattaaataattagtaacctttagtaaggtttggtaaaggtttagtaacctttagttaacccagttaacttctgtgtcttatgcttgtctttgtactgaagtagttgaatgccactgacccacagaatgagttgccagagaattggagcaacattctgttgtgggaaagagaatactctgttctaccttaaaattagattaccagcatatcaattgaagggttttaaatagtgagtgatgtgtttcaatttatatttatattatatttacacttgatcttagccaaaagtctgagtagtgattttatattatatttataaagatcactttagctttctcctggagactggattggtagggacaaggtgacattggtgaacttggttagaaagtcagtcaagcccgtgtgcagtggctcacgcctataatcccagcactttgggaggccaaggcaggtagatcatctgaggttaggagttcgagaccagcctggccgacatggtgaaaccccttatctactaaaaatacaaagattaggcaggcatggtggtgggtgcctgtaatcccagctactcaggagattgaggcaggagaatcacttgaactcgggaggtagaggttgcagtgagccgagactgcgccactgcactccagcctgggcgacagagcaagactcagtctcaaaaaaacaaaaacaaacaaacaaaaaaccagtcagtactctagggaagaaataacaatagctatattatgacatagtagtgagttgaagataactgaatagccaaaatatattttggagatagtttgatatgagaggcgaggaaaagtaagtagtcacgtgtggctctttgtttctggctttaataactccagtagttctggaagagacttagtgggaaaattaaggacattttggataaattgagtttgtccaaatggggtttccaagtggagagttgagtaaatgaagctagagctcaggaaagatgtggaccagagttataagtcatatttatttatttatttattttgagacagagtctcgctctgtcgcccaggctggagtgcagtggtgcgatcttggctcactgcaacctccgcctccggggtcaagtgattctcctacctcagcctccagagtagctggtattacaggcgtgggccaccatgcccagctaatttttgtatttttagtagagacgggggtttcaccatgctggccaggctggtctcgaactcccgactttaggtgatcctcctgcctcggcctcccaaagtgtttggattacaggtgtgagctactgcgcccagcataagtcatatttaaaacaatgggaatgggtaggaacacctagggatagagtatgggaaatagagtagggtccagtatacagctgtgccaaatttcacatgtacaggttagatagtggagtgggtcagttctgttgagaatgccctgaaagcttgaataatgataagcacgtccattttaacatcatgaggtagtggtgacgttgtaagaggagtttcagtgtagtgggttgtcatgggttaaaacgttcagattgtcatgggttaaaacgtgaattggatatgaggaagtggagtgtgcaaagatagttttctgaaagttttacttggaagaggacaaaaaattgagactagacagtttgaggaggatgaaaggtcaaggattctaagctagtgataaaaatttcgtcaacatcaatgaataggtaatgtaaacacgttaatcctgggatggatgtgagaagagcaaagaaaggagtcatgggggaatatcagctctaaaggttgagtagagaaggaaggagtgatctgagaggtggaaggaggagtaggaattatcatagaaactttaagcttcttgagggcttgtgactgtgtcatgttcatcattttatctgaagttcttatcaacaaagtagctttcagtaaatatttattaaatgaagacaaaaattttaagagccatctgcaatgtcaaatgtagcccacagttgaatgaatatgaggaccgggaagtgtcccttgattttggagttaagcagctgattgccaccttctgtagaacagcttcagtggagtctccatgatagaaataaatgccaggttgctgaggactaagcgtggatatttgttgagagtggagacagtaagtgcaaacattcttttcagaaagctttgctctttttgaagctttgctcatagggagatacaagatagtaggtagaggggcaggctgtgtttagatgagagagacttcagcatgtttatatgctaaatggaaaaaggaaaaaggaagggagaagttgaagatgtagaataaaggaggtgtgtgtgaatgattgtacattgtctttgaggttagtgggaatggagtgaagatactgggttgcagtacagatgagaatacagtttccactgaagtaggaataaaggaacaatagatggtgcagatggggaagtgtttgggtggcaagtgagaattctggatatcaacactttatttttttcagtgaaggggggataaggtcatccactgagattatagtggggatgaaatgatgattgtaggggactgaggagaaaaggagaatttcaagaaagcctctgagggaagtgagagggcaagctgagtgggaatacttagaaaaaatggaatcatggatttttcacggctgtggtatatatatttgtatgaatgatttcctccttctctcagggctcagcagcctgggtgagcacacaattgaacagttggattggtcttggcctgggttttatgtgtcagtgtgacagagagggtaaggaggcaagatatttcagtagcgagagtgtttgaagtgatgggccattgagtctaggctgaatagggaacaaatgaaaccagaaggtggctgctgggacatgaagtggttggtgttcaagactggatagtggaaatgaagattgaacgggaggagcagttgctgggtatgacagaatacaggatccagctatggagtgggtttatgaagtagagacaacgttcccaagtctttagtgaacatcagagagtgtcatctgttagaactttagctgcggccgggcaaggtggctcatgcctgtaatcccagcactttgggaggccgaggtgggcagatcacctgaggtcgggagtttgagaccagcctgaccaacattgagaaactccatccctattaaaaatacaaaattagctgggcatggtggtgcatgcctgtaatcccagctactcgggaggctgaggcaggagaatcgcttgaacctgggaggtggaagtttcggtgagccgagattgcaccattgcactccagcctgggcaacaagagtgaaactcagtctcaaacaaaaaagaacttttgctcaaaggcaggtggtagcagataagaggtaaggaaaatttagtgaagaaaaattcagtttttaaaaacgttttaggctgggtgtggtggctcacgcctataatcccagcactttgggaggccgaggtgggcagctggcttgagcccaggagtttgaaaccagcctgggcaacatggcaaaaccttgtttctacaaaaaatacaaaaaattagtcaggtatggtggcatgcacctgtagtcccagctacttgagaggctgaggtgggaggatctcttgagcccaggaagttgaggctgcagtgagctgtgattgtgccactgcgctccaacctgggcaacagagggaaaccctgtctcaaaaaacccaaaaaaaacaaaaaacaacattttattttggtgatggaattctctattgtttcgaagagttttgtttgttttaaagacattaaccagttttctcgagggatattctatgaaaaagtgggttccatcatccaataagtttgagaaactgcaaactctatcccgttggtaattcacaatgaacctcaacttagattaataaaggctctgggaaatgatgttactattaatgatttaacatttattgagcactgtctaaggctctgttctaaggctcccacatgcattattgtttccagtctttacagcaactatctcaatttaagtcacacggctaagctggaatggaagagctgggattcaaatccagaaagacttgctccataggattctcaagcctataaccagtatggaaacaggcttgacattaaatccagcatttccccatcttgtttggttatggaaccttattatcttttagtatttatagagagattagtcagttgtccacggcatggaccctgggaagtgttgcctgagtcagtttacactggtgactacagtcttttaaacagcattgtttcagactataactagttttttctaacttggttctctgttgacaatacttaaatgttatatttatttttctatttgagagccttatattttgacttcaaggcattttctattccctttcacaatgaccttcccaggaatcaaagatattgtcaccaccacacattacatttgagttactaaaacagtttataatccaaatagctatttcactttcctttctctggtctaagattatcttactgtaatttgttttttaaatttagagacagggtcttgctatgttgtccaggccagtctcaaactcctgagtagctgaaaatataggcatgtgtcacctcaaccagtttattgtaaaattttaatgtttagagatcttggagatcatcttttatttttagcagtatttatttagttttgcaggtagagaaaatgacagctgtgtagtgctgtggaaattataataattcatatccaagcttgaatgtcagctccacctctttactatagctgtggccttacaaaacctacttcgtttcttgaaacttgtttcttcctctaaaaagatgaggataatatcttgcagggtggctatgaaaattaagacagttcatacagtatctggcacatggaaagttctcaatgttaattacccatttttttctgtttaaggaaatagtctcaatcctataccatgaatgaattatgaaaatagttggaaaggaaacaacagttttaaatgtaaactgtctcagtcttatgctgacatcagctacatttctggtaaagtgatggtgtcatgatacaggttatattaagagttaaaaccagtttccttctggctttccaactgacataataagcaaaacctgcctgggcaaacatagacctatttattggctcacttattattaatgttaaagtagctttggtgctgacttctcctgttcttgttttaaaatttcactgttgtcatttaaaatctgacagaccttcagaagcttcatagaatgcttaatggtttaaatcgtctctagaacatgtgaagtatcttttccaaagtggttttctccatctgtcagtatgttcaaaatcatgtgtatagggccgggtgccggtggctcacgcctgtaatcccagcactttggaggctgaggcgggtggatcacgagatcaagagatcgagaccatcctggctaacatggagaaaccccatctctactaaaaatataaaaatcagctagccatggtggcacgcacctgtagtcccaactactcgggtagtcccaactacttgggaggctgaggcaggagaatcacttgaacccgggagacggaggttgcagtgagccaagatcgcaccactgcactccagcctgggcaacagtgcaagactctgtctcaaaaaaaaaaaaaatcatgtatataggacagaattgcttatattttcacatttactactggatgcctgtttggttttcatagcaatcaacttttggagtttatgggcagtacttaacatatataacctaagtgtggataattatttaaaataaggctattggaagaaaaatctatagggatttctcagttttcacaacaactccctgagcaaagaaaaaataggttggtttgagttgtatttgatgagatttctaatattctatttgaaatgccccctagtaagcactagtgataggtattaatgagctgaatttgatttccagttccaactctgtcccttgcaacttctgtaaccttgaaggtttctctacgtttcagtttcttcatatgtaaaagagattaccaatatttccctcccaaggctgctgtaacagtgaagtgttgaggtttttatttatttattatttatttatttatttatttatttatttatttatttatttgagacagagtcttgctctgtcgcccaggctggagtgcagtggcatggtctcggctcactgcaagctccgcctcccaggttcatgccattctcctgcctcagcctcccaagtagctgggaatacaggcgcccgccaccacgcccggctgattttttctatttttagtagagatggggtttcaccgtgttagctaggatggtctcgatctcctgacctcgtgatctgcctgcctaggcctcccaaagtgctgggattacaggtgtgaaccactgcacccggctgtgttgaagtttttaatatagccagcacagcatgtggcacatagtaggcacacagccattgcatgtttcttccagacatctcactgcatttttcagtaatattcttttcaagtacgttcttctttctcattccttaacatttaaaagctgtattcaagagagaatattaatgtttgccaagtaaactgaaaatatttcctttgcagcccacacttaagagtgttttaggccgggcgcggtggctcatgtctgtaatcccagcgctttgggaggccgaggtgggcggatcacctgaggtcaggagttcgagaccagcctcagtatggagaaaccctgtctctactaaaaatacaaaattagccgggtgtggtggtgcatacctgtaatcccagctacttgggaggctgaggcaggagaattgcttgaacccgggaggcagaggttgcagtgagctgagattgcgccattgcactccagcctgggcaacaagagcgaaactctgtctcaaaaaaaaaaaaaaaagagtgttttagcaaaaaatgattttatgtatgacataccttggtttaaatcctggctttttaattttaattttttattttttgagacagggtcttactctgtggctgaggctggggtgcagtgatgtgatctctgctcactgcaacctccgcctcccaggctcaggtgattctcccacctgagccacctgagtagctgggagtagaggtgtgctccactatgcctagctaatttttctatttttagtagagacagagtttcaccatgttgcccaggctggtctcaaactcctgggcttaagctatccaccagcctcggcctcacagtgttgggattacagttgagagccaccaagcccggcctgaatcctggcttttgaatgtaatagtgttgtgaccttaggcaagctacttaacctatccctaaagtattatgaggctaaagtgagtaatagtatgtataaaacatctagttcattgtctggtttgtatattcccaaaataaatgttattattttaagtggaaactgttgtttaatttgataattcatataattcatggcttttgagagcctgctctactcaaagcccgttaagagcaggcaggaacattgtgaacgaatgttgggcatattattatgcaagtgactgaatttggccttgcctgtaatcaggttcagcaaaagtggtattttctttctttctttctttcttttttttttttaaattgagacagtctcgtcctgatggccagactggagtgcagtggtgtgatctcggctcactgcatcctctgcctcctaggttcaagcgattcttccacctcagcctcccaaggagctgggatcacaggtatatgtcaccatgcctggctaatttttgtattttttgtagagatggggtttcgccatgttggccaggctggtcttgaactcctgacctccagtgatctgcctgcctcggtctcccaaagttctgggattacaggcgtgagccactgaacctggccaaaagtggtattttctattgcatttgaggtaacagaaattgatgggcttgttattgcatttggcgtggcttttttttttttccatgttgtctttctccactgactgtcaaaaaaaaaaaaaaaaaaaaggctacattcatgagtgccacaagagagatttatgattcccaagtgctacagcagaccaaggtatattttggtatctaaaaagtttttcatcttttgctgatcttgtttattagaaataaagatgttactctcctgtattaaaatttaacacaatattggcaagctaaatttaatcaaatattctgcccattttaaaattcacttcctagcctgtccatccttccttttattttgttgtttgattttgttttattgtatgcttttagcagcctgaagccatggtttttagtttctgtctgtagtgataagtggaaaggagggatgaggaaggggctttactggcccaaccagaaatagaaactaagaacccaggactgtattatctcccttggacacccaacactatataaaattgattcctgccctggcagactaagcattggaaagctggtgctaagagtgttatgagaattcctaacaaatagaaaagctcaaggattgacactatagtaaaagatttcattttgacatgtttataatttacttatcaagttaacaataaggtgtttttatttatttatttttgtttatttttattttatgttttgagacggagtctcgctctgttgcccaggctggagtgcagtggcttgatcttggctcactgcaagctctgcctcccgggttcacgccattctcctgcctcagcctcccgagtagctgggactacaggcacctgccaccacgcttggctaattttttgtatttttagtaaagacggggtttcaccatgttagccaggatggtctcaaactcctgaacttgtgatccacccgccttggcctcccaaagtactgggattacaggcgtgagccactgcacctggcctttttttggtatttttagtagagacggagtttcaccatgttggctaggctggtctcgaattcctgacctcaaggcctgccttggcctcccaaaatgctgagattacaggcatgagtcccagtaagatttttaaagggataccaaaataatcaacatttattttagaaggtgactttcttcaatgagatgtcaatgtctactttctgttatatagtgctatggtttcttttttcttttttttctaagtgagggtctcactctatcacccaggctggagtacagtggcatgatctcgggtcactgcaaccttcacctcccaggttcaagcaattctttcacctcagcctccagggtagctggaactacaggtgtgcatgcctcgctaagttttgcatttttagcagttgttggccaggctggtgtactgtttcttttattgactgagatctatatttacacagcatgaaagtctcagttgcattaagtacattcgcattgttatgcaaccatcaccattatctagttccagaattttgccgtcaccctaatagagcttgtatatatgtccccaccaaatcttatgttgaattgtaattcccagtgtttgaggtggggtctggtgagaggtgtttgcgtcatggggcagatccctcatggcatagtgttgtcctcgcagtagtgagttagttctcacgatctccttactccatccacctgcttctcctaaaactttgaaatacgcttggaattgaaagtgtttagtttagtttgaggatagttatctaaaagtgacatacagggctcctgctttgctcttccttagtaaatttcctattttattacacagtttactaatacagaggacttgagttttgttatttccatggaaaacattattgaatctaaatttaactagagatgtgtagttcagggagggagagtggttttataatatgaatcttggatttgaaatgaacttaaagcaaatgaataaaaattgtttcattaattataatgtctgaaataatgcatgtttttgtgaataaaaattgatataataaagtttaaagtgacaggagtagatataactaattgtatttataatttcttggaagtaaaataacatttttgaaaaatattatacaatgacctcacatacagtgacctcacttaatctatgtgaggctatacacagtggctcatgcctgtaatcccagcactttgggaggctgaggcaggtgattgcttgagcccaggggcttaagaccagcctgggaaacatggtgagaccctgtctctacaaaaaatacaaaaatcagctgggcatggtgaggcgcacctttggtcccaactacttgggatgctgaggcaggaggatcacttgagcccaggaggttgaggcagcagtgagctgtgatcgcaccactgcactccagcctgggtaacagaatgagaccctatctcaaaaaaaagaaaaaagtctatgtggaagacaccgcgttaattgtgttgggtggtttagagatgtttctgtctccttcactgatgaccgtgtgtctctgctgctgtcgctcactggtgattatcaactcaacctcttatatttgttttaacaaatatttatacaccctttgtaaatttgcgtgagataaagtcattatagttaaaaaaaattttttttttttttgagacagaatcttgctccattgactaggctgagtgcaatgacatcatcatggctcacggcagcctgaacctcctgggctcaattgatcctcctgcctcagcctcctgagtagctgaaactacaggtgcatgccaccatgcccagcttgttttttattttttgtaaagacagggtctcactatgttggcaggctggtctctaactcctgggttcaggtgatcctcctgcctcggcctcccaaagtgttaggatttcaggtgtgagccaccatgcctgtcctatgaagtcattacaaagaaataaaattaattggtttcattggcagtattgaatttcaaagcagaaggggtgcttaagagaaataatgcctttggagtgatttctgatgctagatgaaactcatatctcatttaaggtgtccatctgaattttatgtttggatgattgtgaattattccttaaagcttgaagtgaactctggctctctaggataaattaatctttattcctttaatctttattcccttagggatatattaaagggatcaaatttttttttagagtaatgtaaaattaagggacttcttttgttaggtgaatttctcaggttttaagatatcagtatcattgtggacattgactacattgtctactaaattctgtaattttaacttataattctcagtaattggctgggtgcggtggctgacgcctgtaatcctagcactctgggaggccaaggcagcagatcacctgaggtcaggagttggagaccagcctggccaacagggtgaaaccccgtctctactaaaaatacaaaaaaatgagccgggcgtggtggcgggtgcctgtcatcccagctactggggaggctgaggcaggagaattgcttgaacccaagaggtggaggttgcagtgagttgagaatgtgccattgcactccagcctgggtgacaagagtgaaactccatttcaaaaataaataaataaataataaaaataaaaatacaaaaattagctgggtgtggtggcgggtgcctgtaatcccaactactcgggaggctgaggcaggagaatcgcttgaactcgggaggcggaggttgcaatgagccgagatcacgccactgcactccagcctgggctacaagagtgagactctgtctcaaaataataataataataataataattctcagtaatttttgcaatttttttggtacctaaaataatttctgttattgtgttggataactttgtcaacttcactttgggaatatctaaatacaggtagctgcattcgagccagaggaatattgggtttttttgttgttgcttatttttgaggcagccttactttgtcacccagactggagtacattggcacaatcatggctcactgcagccttgaccttctgggctcgtgtgatcctcccaacccagcctcccaagtagttgggactaaaggtgtgcaccaccatgcctggctaatttttaaatttttttgtagggatggaattttgctatgtcacctaggctggtttcaaactcctaggctcaagcagtcctcccaccttggcctcccaaagtgctgggattacaggtatgagccaccacacccagttgagaaatactgggttttaatcaagattattgtctgaatattgagtcttaatgacttttttgattttgtttttttggccatagtattaagtttgcagttgataaccttctgtactaactagaagtagtatagaaactgcaaattaaaaaaaaaaacccaggtaaaatgttgatggctgctatttttatttaaggtattaataaaggaaaagaagtcagggacattatggaggtcaagttttatattattaaaactcaacttcatgatttatacatacttagaaatagtctgagtgatgtgtgaccaaaatatgatttctaggaggaatgattgttacatccgtggaatagctgcgtacactttattgttcttggtgcttaaactttagttgtcctgctaagataaaggaagacattctttcagttggaaatcatgataatgtatttctccattgaaacagtatggtttgaacagtgctatatattcatactcattattattccttaaatgaatattttaagctcctgatagaaggcaggtactgtgttatatgctgtttgtgttaccagaatacaaagatgaagagaacaaagtattacacaattcctaatctcacataaatgctattttttttttactagctgtggggagcacaaaataagtggttgaaagtcatctgacacagttacatttattcctttccttttccatggctcttaggaataaattgttctactctatggattaaattgccctttgtttattgcctgggatcccaactttatttcataattttatttctttgaggaaacgtttcacaagttttataacaaagtataactcaatttggagagcacaatctgtgcataagttggaggctacctattgtgaaatggaaaaatgcttgtcctagcattactgagttaatgtatagctggtagaaagttttcactcttaattgctaacttgcctagtgagagtgaaagattgattacggcaactaaaaagtataaaaactactgagtagtttttaggtacagtcagttcttcagtagaacaagaatctttagaaataactttcactaattctttactagttgtttttcctatttctcttggatatggatcatcagaatgttttttgtccctcttacccgccccccccatcccccaccccccgcctcccacttttttgttgggaggcttatgtgagagcattagaggccttgaatgtttgggtagacaaggtaagtattcaaataaacgtttcaagatcattgtgacagtgaaattatttgatatgaaaaaggatctcagttattagaaaaaacacaactgtgttaatactgacagccagcgttgctataagtgttttatgtgcattatctcacttaagctttacaacagtcctaagagaggaatgctgtggttattacacccacttgacagaccagggagcagaagcacagaaacccaaggatttctgctgtcaatgtcatgcatttggctggagttatgatgtcgtgcaagtaatgttccttctttttccctctaattcatttttatgtttttcttttacagggcaattttgtaagatttagtttccaggggtcaggtttgtttgggctttatgtccttgggaaatcctcagtaccttatttcccatattccatactttttaatcttaattttttttcccctcaaatgttatacagtttaatgagtcaagtggtctttcagggattcttaaaacaaacagtaattctcagcctccaccttcatttcctcttctcataggtaaccatcctcaactcataggtatttggaatttacctgcggtttttcaagaaacatttaaaaaattgatttacttgaattttcaggttagaacataaattatttgcatgatttgctgtgtccttgtgactaactcaacctaaacattctatcagttgtccaaatttcccattttctttcaaatttcccatttccttcacttactttgtcagtttcatcatcttgaagaagacttttccagagcacagtgctccaacatggagtagtctctgttttctcatagtgcccagcaatcatccttggaattctcttttcttttctcctgcattggcacttctgtttcttctcctcttatgtcttcctgtttcatgggaggcaaatatttgataccttatgttttctgaaaacactttattttcctctcacccttcattagtggtttcactgtatgtaacattgagattgatgattttgctccattgtcttctagcttgtgttatgcctgttgaaagtacaaaatcattctggaagtttatctattgttagccatttccctcttctggaagcttgtaggatcttccctttgtttccactgttctgaaacttgtaaatgatacgctttaatatggttgtactgtattttaaacaattatgctctgcactcagtgtttttttgttgttgtttttgttttttaatttttaaatttatttatatatttttaaatttattgtttttgtttgttttttgagacagaatcccactctcgcccaggctggagtgcagtggcatgatcttggcgcactgcaacaacctccgcctcctgggttcaggtgattctggtgcctcagcctacccagtagctggaattacaggtgtgcatcaccacgccaagccaatttttgtttttttgttttgttttgttttgtttttttgagatagagtatcactctgttgcccaggctggagtgcagtggtgcgatctcggttcactgtaacctccgcctactgggttcaagccattctcatgcctcagcttcccgagtagctgagattacaggtgtaccaccacgactggctaatttttttgtatttttagtagagacagggtttcaccatgttgggcaggttggtcttgaactcctgacctcaaatgatccactcacttcggcctcccaaagtgctgggattatgggcgtgagccaccgtgcctggcttcactcagtgttttcagttacgaaacttacattgtttagttttgggacattttcttgaattatttcactggttttttttcctctctgttttctcctgtggattccccattgcatagatgctgaattatcttgactggacctccagttttttcttcttgattctgttgccatctctttgattccttattctttctgataaattttcctaagtttaatttccgagagctctttggaaaagtatcgattttttttcatggatggagtatctactcttttgacacagggtcttgctctgtcgtggctcactacagctttgattgctcaggctcaagcgatcctcctgccctagccctcccagtagctggtactacaggcctgcaccgccaaacctagctaacttttttgatttttagtagacaaggtctcgctgtgttgcccagactggtctcgaactcttaagcgccaagcatttctcttgcctcagcctcctaaaattctgggattacagtgtagtatcttctgtattctttccatggacgctaatgatggggtataaaattccttttatttatttattttttattgacatcagaaattcctgctaataaaattctttttaaattttaagtttttttcttcccacagttgtccgtgtttcctccaagttccttttctattttttgttttcctttgttttctttttgtggtagatgctttcctcagatgagtggtaatccttggctgtttgcagttatgcctctaaaagctgattggaagctcttagtacctcattggtacttgttgactagagttcactctagggtgatctatctgtgtcatttgctggggcacccttcatgtcagcttctgattacttttcccttttctgaaaagggagagaggtcttttaatttcctgtctggtgggaggaggtctgtatgccacttctgtgagagagtgagggaagtagggcagtgaggatttcagtattcagtacatatgtgttttcttaaggcctctgttttcattaagcctcccccgcaccaatgtgctttatgtttccctgctctgaaatcctcctgagggaataatcctctagaattttgccttggtgggaaaagcatagtaacctaaccatgtggtatttaggaaggtactgagagattgagcgtttcctaaggagctttcagccagccttctttatttagtgctcccttcacacctgtttctacaggcgctatctgttaccagttcctgagccttttgaagattccgtggacgaaggttggtttttggctttccatactgctggtttcttggatctgctatgtcagttaccatttatgcatttgctttctagcttttaagttttgtttatgccttaaaaatacctgatgagggccaggcgtggtggctcaggcctgtaatcccagaactttgggaggtcgaggcaggtagactccttgcatctgggagtttgagagaagcctgggcaacatagcaaaaccccgtctctactatagaaaaattaacccggtgtggtggtgcacgcctgtggtcccagctacttgggaggctgaggtgggaggatcgcatgagcctgggatgtggaggttgcagcgtgctgagatcatgtcactgtactccatcctgggtgacagaatgagaccctatctcaaaaacaaaaacaaaaaaaccccaaaaaccttattagtattttagcacaatttggggaagaaatgaagttaaatatatgtatgttccatcttctctttacccagaacttatttctaattttttttttgttaagcatcttttttgttgtggtaaaatatacataaaatttattatttataagtatacagttcagtgacattaagtacattcacaatgttttacagccatcactactttctagttctagaacttttctatcacaccaaaaagaaaccccatacccattaagcagtcactccccattccctccctcccccagcccctggaagccacgaatgtgctttttgtttctatggatttgccttttgtggatatttcatataaatgaagtcattcagtatgtggccttttgtcacatgttttcatttaccataatatttttgtggttcatctatggtatagcatagatcactgcttccttcttttttatggctcaataattttcattgtgtggatatatcacattttgtttatctgttcatcagttgatgaacttttgggttgtttctgctttttctggctattgtaaatagtgctgttatgaacactgatgtacaatttttgggggtgaacatttgtttttattcttttaggtatatagctcggtgtggaattgctggatcatatatggtaattctgtctttaacttaatgaggaactgccaatctgttttcctcagtgactgtaccattttatattcctattagcaatacacaagtgtcccaatttctccacatttttgccaacactgttttccattaaaaactttttattatagtcattctagtgggtgtaaagtggtatctttttgttttgatttgcatttccccagtaactaatgacattgagccttttttcatgtgcttgttggccatttgtatatcttctttggagaaatgtctgtttaagtcctttgcccactttaaattgtgttgtctttgtgttgtagagttgtaagagttctttatacattctgggtactagacatgattttcaaatttagatacatgattttcaaatcttttgcctctagatgttttttacttttttatttttgatccttgaactcatctatattctatggttgtgatgtaatgatgacagaattggtgtcatttgtgtttatttaccaggttatttggaaggattatattttaggtgctctcctctcccccagtaaatggtattacgacacaagggttataaaggactgataagaaattacttaagacagaaagggaagttggcctgcttccaaaatgtggtcccagcagaagtgaagttagttacaccaataaccacagtcaaaaagctatttttaaccatgataatgtatttgttgttattaatattaaagattatattttgccaggtgcagtggctcacatctataatcccagcactttgggaggctcaggcggatggatcacttgagctcaggagtttgagaccagccagggcaacatggtgaaaccccatctctacaaaaaatgaaaaattaaccgggcttggtggtgcgtgcctgtagtcctagctacttgcgagtctgaggtgggaggatagcttgagcccaggaggtcaaggctgtggtgagccgagatcgtagcactgcactccagcctgggcaacaggacaagaccctgtctcaaaaacaaaacaaaacaaaacaaaacaaaacaaaaccgactatatttctgcattaagtgggggtttggaatcctatctaatatttgagataataattgttatagtattttattgagcttttattgggtaccagatgtgttctaagtttttttcgtgaattattttcattaatcttattcattgttgtgtcctgaatgagtactcacatatttgttgaagggctcaatggtccctaaaaccttagatgctgttttggaaggttaacttgccaaaggtcacatagttggcaaatgatgaagctgagattaacattaagatctgattccaaagtagtctttcttaactatattgctttatgtggagttttgccattgatgtctagacagaaaatctctagcaatggaaaaaaataatttttaattaattttaatttttttagtgttttgcttctttttttttttattttgtgagccaccgtgcccaattggtttcttttaaaagaccagttagtttgtgcattaggcctcttgattaatctgaggtatttaattaatatctttgaaatccttagatttactgtatcacttctgcaatatctaaatttttccttcttacttatttctgttctccttctacagtcctttctattatgtttaatcatcaaaacgttgttcttgttttctattgcaatctaatttttagtgttatgctgtttccagatgccatttgggtcattttcaaaaaaagatgagtaataattagcaagtaatgaatattgttctttttaccattcattaagaacaattgttaattgtcttattctattgtgaagaatatctgtaattcctgcttagaacctgggttgatagcaggatatcaggaagcactaagtgtacacagaacgatatagctggaaaaagtatatatgttaaagaataatatgttgtctaaggatgatcacacaggttcttttttggtaagcttcaaaacttcttatctcccatgaaagtactttttcttttataatatgcaacaataactttctgtttagttaattagttttaaaacaagcttaaacttataatttataaagaatcatatttgctccctatcattgttttatagctggggctatactgacaaataagaaaaataaaattcctgcccttgtggaggagacagttaaaaaatgggacaaatacatttcagatggaaatgaggacaatggaagaagagtagagcaggatgaaggcatgaagggtgactgagatctggtcaatctttagatagtgtaatacgggaaactgctttgaaaagatgacttttgagcagagaccttaatgtactgagggagtgaaccattcgaggtctggggaaagaattcagcttcctcttcagatgtacaaaattacaagatattgccattcttgtaactgaaaacctataaaagcaggataagaagtacggtttctaaaaacccatcgaagagctgaggatacaagggagcctaaatgaaccaaactccagaaagtaatcaaactttcatagtggagaagaaacccatggttgctctaggatggaacaacgaaaggaataggaatccaccatagatgaggggaaaggagaaaccagccacatttttttaaaatcagatttttaatggccacgtatgggctggtttgacaggttaggatcctaagaagccctagcaactctggcaccaaagagcaagtatgcacccacactccagctcctacccacagatgttcactgaatgttcaggagtagtaagccaaaagcctgggccagtgacgaactggcatagataatacctgaggcatttggaacctctcccaagtatagggcaaccacccttagaaggcaggattgctgagaaaaatccagcagaggctctccaggctttcagttctggaatgctgcaggcaggggaagagctagaaataactctcaccccacactctggcagtccatgttttcagccaccaaggactggggacagggcagaagaggtgagtgaaactgctctaattcatttcaggccttcacagaatgtaaggaagctgccctccagaagcctggctggggaggaggagcagggctgcacgagggcacctgagcttcagaaagcaaggtgtgcgactggagagcaaggagaatctagcaaaccaaactctgaccgtggcgcttaatgcagagatagagttcctacagcttttttttctttcttttttaaaatataaacttgaatttttgaaacagtttcagatttaaagaaaaattgccaagatagtatagagagttcccataatgctgcctctagtttttcctatttttatttaatttatttatttttttagtttttcctatttttaacaccttatattagtatggtatatttgttataattaatgaactaatactgatatattttcattaactaaagtccatactttatttacctaatgttttgggatcccatttagctgtcacgtctccttagggtcctcttggttttggcattttcttagacttgagcttctcatctcttgtttttgatgactgacagttttgaggagtattgttcaggtattttgtagaatgtcattctattgatatctgtttggtatttttgtcattgttacagtgaggttttgtatttttgggacgaagaacatgcaggtgaagtacaatttgctttcctttttttgagacagtgtctcactctgtcacccaggctggagtgcagtggtatgatgacagctcactgcagccttgaactcctgggctcacatgatcctccctccttagcttcctgagtagctgggactacagatgcatgccaccacacctggctaatttttttttttttaatagagacagagtctcactgtattgcctaggctggtcttgaactcctaggctcatgcaatcctcccacttcagcctcccaagtagttgggactacagacatgtgccactatgcttggcagtaccattttcatcacatcatattaaggggatatactgtcaatatgactaatcagtgttgatattgaccttgatcatctggttgaggtagtgtttgtgtatttctttactacaaagttactcttttttctcctctgtttacatactgtactctttggaaggaagttacatatgcgcagcctacacttaaggcatggggagttatgatacccctcctcaagggcaaagtgtctgtataaattatttagatttcttctgcatggaagatttgtctcttcttcctcatttatttatccattcaatttttaaaatattagtatggacttatggatattttataccttgggttaaaatcttattattgctttatttattttattgttcaagttgttccagctttggccactgggagctctttcagttggtatgactttttgatataccactgtcagtatatgtgtgtatgtgtgtttgcactttctcactttctggcactacaagatgctctagtatatttagagactaaagcatgtagtatatgctttagtatatgctttatctagtatatttttctgtctcaatcctagaattagccatttctccatggagccttggttccttttactggagaatggagaaaccaagatctaggtgctaggtgtacatgttgctactggggtgtttttgcttgtaggccatctcagctgacagagccagaaaatgtatgtatttatactaccctgtatatatccacatatctataaatatttctatatgtatccatccgtatctaattaagctaaacatgagtttatattgatgtattaggttccagttgaatcactacatggatgattctaacttcctgcccttgcttatctgaaaactcctgctccaatagtgagaaatctgtctcctaccatcagccacccatttacttaatcattctactctagtatacatgtaaggtactcccacagttttaaaaattggtggcttggctatgaaacacaagcaggtctctgtaattttacctaggctcagatcccagacctgctcaagtgaaaggcttgatctcagtccttaaatatttgaagccagtgattaatgttaaattaaagctgcatcatagcccacacccagctcagttacatattggattgactcagactcccttctagtgtcctaacagaaaaattgtcatgtctttttctggaagtaaaatattacttaatttaataagtaatctatttttatataaaatgtctggtgtgtaatgaaaagttacaaggcacaagaaaagcaagaaaatgtgaccaaaggtcaagagaagaaatagtcagtagaagaagacccagagatgatccagatttatcagacagggatttaaagataattatgaaaaaaatgctagatgattgaatgataaaggttaacaatatgcttgaaaagatggggatttctgtagagtcatggaaattatgccaaagaaccaagttgaaattctattaaatagaggtgaaaaatatactagcagagaccagggaaaacaaaaaaaggaaagaaaagaaaaggaaagggaagggaggggagggaagggagaaagaaaaatatactagcagaaatgaattcattacatgggcttaacagtttatggacatagcagaagaaagaatcagtgaatatgaagacagattggaaagagaaaagacagaaaaagtcagggaggggtagaaaagagattttagatctgtgggataatatcagatggtctaacatatatgtaattggagtttcagaaggagagaagagaacgtggcagaagacatatttgaagagacaatgctcaggaacttctaaaattgatgaggtcatcaattcacaaatggaaggagttcagcaaatcccaagcaagttaaatacaaaacaaaaataagccaacaaatttaaaaatcccatatataggcatatcataatcaaactgctgaaaactgaagatggaagagatcttacaagcaacaggagagcaacaggagaataaaagacacattagttatgtgagaatggcaacatgggttatggctattccatgttttaggaccagaaaaaaatggagtcttagctgagcatggtggcacatgcttgaacccaggagtttgagtccagcctgagtaaagtagtgagaccccatctctatttaaaaaagaaaagaagtccaggcacggtggctcacacctgtaatctcagaactttgggaggtgggcaaatcacaaggtcaagaggtcgagaccatcctggccaacatggtgaaactgcgtctctactaaaaatacaaaaattagccgggtgtggtggtgcacacctgtagtcccagctactcgggaggctgaggcaggagaatcacttgaacccaggaggtggaggttgcactgagccgagatcatgtgccactgcactccagcctgtcgacagagcgagactcagtctcaaaaacaaagaaagaaaagaaaaggaaaaatagaatgttaaatacaatgggatgacatccataaagagctgaaagaaaaaaaaaaaaaacaacctgttaacctagatttctatggccagcagaaatagccttcaaaaataatggcaaaataaagactttttggacatatcaaaaagggaaagaatttgtttccagcagacctggactcaaaaaacattaaaacatacacattaacaagatgtgggttttacagcatatatgtgattatacaaccatgaaagaacaaaaaggaggagatggaattatactgtcatacatttcttactctgtgaaaggagactgtagtaacttctggatgcatatgtaatctctagaacaagcactaaaaacacaaacagggataccataaagtcagtacatctgcccaagagggattaaccgctacgagaatcattctcctactgtaaacagctagaaaacaggacaaaaatacatgaaacaactgttttcagacattggacaacaggcagcacaggatagtgatccctgagagaagggaaataactgatatgaaccctacaggggttcctataggcagtttccagattgtagcacagagtaggggaatccaaatagagcccaggagagtttggagaagtcaaggcaactagaatttgtggggcagaaaacaagaataaaaggaactacacagaaatctatagaagtaagagaatctttgattggacactcatctgcacatgtgaagtgtggaagtcagcaatgctggagaaagtcacactggaaatcagaacactgaacaattccaggagctcacacagagctgggaatagtttatgtttccattaggcatagtggagagactgtttcatacaaaggacattggctagagtcttcaaagtggggttaaattagctatagactaaaggcctttctaaacctaccctaagcttcaaggcaggttttgaaaggaccaggctgattctaagtaactcaattatgtgccaaaactaaactcttttaaagaatacagtaaatgccagcacctaacaattaaaatgttcagcattaataatatattaatgaaagattactaggcatacaaataaaaagcaggaaaatgacccataaccaggagaaaaatcaatagaaaagagacctagaaatgtggaattattagaaataattctgatgattgaattatcagccaaatatgttaatacaagtattataatgactagtagagaaatgaatgatagataaaaagacacaagccagatgtggtgaatcatgcctacagacttgagggtaggcagatcagcttgcccaacatggcaaaaccctgtctctactaaaaatacaaaaattagctgggtgtggtgggatgtgcctgtaattccagcttgggaggctgaggcacgagaattgcttgaacctgggaggcagaggttgcagtgagctgagaacatgccactgtactccaacctgggtgacggagtgagactttgtcgcaaaaaaaaccaaaagactcacaagtagtatctaaagatgaaaaataccagatataatatccaaaactgggggaaaaactggatgtgattaacagcagattagacactgcggaaaaaaagatcattaaatgtgaaggtatagcagtagaacctattcacattgaagcacaaagagaaaaaaaatactagaacaaagttaatagaacatcagtaaccttgggacaatagcaagttgcctaatacatgtataattggagttccagaaaagtggggaaaggtagaaggaattactttaggaaacagcgtctgggtggccaggtgggtggctcacacttgtaatcctagcactttggggggccgaggggggtgcagatcatttgagatcaggagtttgagaccagcctgtccaacatggtgaaatctcttctctactaaaaatacaaaaattagctgggcttggtggcatgcgactgtaatctcagcttcttgggaggctgaagcatgagaattgcttgagccagggagatgtaggttgcagtaagccaagatcatgccactacactacagcctgggcaacagagtgagaacctatctcaaaaaaaaaaaaaaaaagaaaaagaaaaagaaaaagaaaataagaaaatagtggctcatcatggtggctcatgcctgtaatcccagcactttgagaggctgagatgagaggattttttgagcacaggagttcaagaccagcctgggcaatttccttaaaaaagaaaaagaaacagtgactataaattttccaaatctgatgataaccataaactctcagatccaagaaactcagtgaactctaaatagaataaacaaatataatcatacctaggtatgtaataataaaattagtgccagtcatggtggctcatgcctgtaatcctaacactttgggatgctgaggcccggagtttgagaccagcctgggcaacatagtgatacccctatgtctacaaagattaaaaaatagaaatataaaaagttagctaagcatggtggcacttgtctgtaatcccacttacttgggaggctgaggtgggaggattgcttgaactcacgaggtcaaggctgcggtaagccataattgtattccacccagggtgataaagcatgacgggagatcctgtctcaaaacaaaacaaaaccaaaaaaaggcgaggcacagtgactcacacttgtaatcccagcattttgggaggtcaaggtaggatgatcgcttgagcccagaaattggagacaagcctgggcaacatagtgagaccctgtctctcaaaaaaaagtttaaaaaggcgggcatggtggcatgggcctgtagtcctgtctactcaggtggctaaggtgggaggattgcttgagcttgggaggttgaggctgcagtgaactgtgttcgtgccactgcactccagcatgggagacagagcaagatcctttctcaataataacacataaaccaatgttacaatgagaagaaataaattctggtgttcggttttttgtttttttttttctgagatggagtttctctcttgttgcccacgctggagtgcaatggcatagtcttggctcactgcaacctccacctcctggattcaagatgattcttttccctcagcctcccaagtagctgggattacaggtgcatgccaccacacccagctaattttcgtatttttagtccatcacgttagccaggctggtctcaaactcctgatctcaaattctggtgttctattgcacagtggggtgagtatagttaagagtaaaatattattacaaaatagctggaagaggggcttttgaatgttctttcactaactgctctgattggatcattatgcaacatggatatgtatcaaaacatcgaactgtggcccggcgtggtggctcatgctggtaattccagcactttgggagtctgcggtgggtggatcacctgaggtcaggagttcaagactagcctggccaacatggtgaaaccccatctctactaaaaatacaaaaattagctgggtgtggtggtgcatgcctgtaattccagctactcgggagactgaggcgggagaattgcttgaacctgggaggcagaggttgcagtgagctgagattgcgccatcgcactccagcctgggcaacagagcaagactccatctcaaaaaaaaaaaaatcaaattgtaccccataagtatgtacaattacaatatgacagtttaaaaaataaattaaaaaaaaattctcttgtacttaccagctgaataaaaaataaatttttaaaaggagagaagtcttcttaaaaaccagttatttaccccatcattaagttataatgaactttcttatgggaattctttgataaggaagctcctttatgctgaagttttattcttttcatacctctttagataaatcagtgctttaggagcatatgtcatatgactcaatggcagtgttctaacttggattctagctccacattgtgcaaaggcaaaaaaccagagagtcagtgtggtagttaagaacttatgttctgctgtttgatttcctacatgccagtactccctccactacctgcagtcttcctgacctggggcaagttccttttgtaaactctgttttctagggggatggtggtggaagaaggatggtgatttgagccaggcagtagcaggtggaggtggagaaaagtggtcaaaccctgaatgaacgttaaagataggaccaaaaggatttgatgagaaattggaagtagagcacggggaaaaagaaagatatcagtgatgatgccaaggtttttggcctggggaattgggatagtggagttgttatttgctgagtatgacttttcacaaaggaatgtcaaggcgtaagtagcaaagttctttttttttttttaatttttcttgattgtgtttgttttgtttttcatcttttgtgggaggtgggtggagatgaaagcaagcacaggggttggcaggcatacccctggcacctacctgtgagttcatgattactagtcttaaagttcagtcctttttatttttactttttttttttttttttttttttttagagacagtgtctcactctgtcatccaggctggagtgcagtggcacaatcacggcttactgtagccttgatctcccaggctcaggtgatcctttcacttcagcctcctgagtagctgggactacaggcacataccaccctacccagcaatttttttaaaaaattttttgtagcgacatagtcttaccatgttgcctagactggtctcgaactactgagctgaagcaacctgtctgcctcagcctcccaaagtaaagtactgtaattacaagcttgagccaccgtgcgtggccaaattctggccttttgatgttgcatggtgtggatggggaggcaaagtgtgatattttaggaatttgaggatttcttcttcgaccttaggcgtgacattggacaaatgacatctgggctgagacattttctagtaatgctggatccaaaaaactcttatcccattgtctcatagcttcattacacagacctggcggccatgatcctcttttttcccccttagttgccaaacatgggttctctgtcttacctcatttgagtcttacctcagtcttgagagtctcaaatgtgtatcatagtttttagacaaaattcaaccttatttcaattagtatttcattgttatttaaatattttaacaggaaaactgagcaatgtttccctttacctgttaatcctgttataatattttagataaagtgtattagaaggcacattcttcattaatagaatatttattcatgtgtttatatggttcttaactaggaataccatatagtctatctccaaccctttgagaaggaaaaaagatcctgactaaacaggacaccagaagggcatgcctaaactaggactgttctgggcaaatcagaaggcatgttcaccttattctttttattctttctttttcttttttttttttttttttgtgacggagtctcgctctgtcgcccaggctggagtacagtgacgcgatcttggctcactgcaacctccacctcccgggttcaagcgattctcctgcctcagcctcctgagtagctgggactacaggcacatgccaccatgcctggcaaattttttgtgtttttagtagagacgggggttttgtcgtgttagccaggatggtcttgaactcctgacctcatgacctgcccacttcggcctcccaaagtgctgggattacaggcatgacccactgcacctggcctcaccctattcctaaggccagaaaaccagctagagtaaagttcactttctgtttgagtgcttggactttattgggagaaggcaaatgccctggaacaagagtgaaagggagaaattcccgttgtattgcaagccagaataagagaggctcacccacactggcctaaggcatctcagttgttgatgagaatgtgattacagatgtctcacttgaataccaaagacaattgcaaaggaaattaaaagttatgcaaagagagtcgagaagtcagttgtctgctcacaggttggctttagtggctattactttgagatactaaatgagcgatagctttaaacttcaactgcttttgtttctgaggaaaaaaatcatcttatatcttttcataagttgcataaaaagtggacattttctattattttaaagagtaaatttaggtacaagcatttactaatttttttttttttttttttttttgagatggagtctcgctttgttgcccaggctggagtgcagtggcgcaatcttggctcactgcaagctccgcctccctggttcacgccatgctcctgcctcagcctccagagtagctgggactacaggcgcccgccaccacgcccagctaattttttgtatttttagtagagacggggtttcacccttttagccaggatggcctcgatctcctgacttcgtgatctgcccgcctcagcctcccagcatttagtaattcttaaaagagttcagcatgaatatacacagtacgtgggttattagtactgtgttgttaacacaaatgaactatgatagcaaattgaatttggttcaatcaggtcaaagaataaaaggatgactttctttaaccaccagcaaaggatagtataatgaaccccatgcaactatcacttaacttcaataatttcaagtttgagtaagttgcagagtagtaatttgaacccacatctctcttgttccaaatcccttgcttttaattacaatcccatgtggcttctttgtcatttgatgctattgagcaactttatgatttttttggtgtttttggtaaaatagacatgaaaaggcattactacagggagttttttcactccctggtaataagaggggaaaagcactctcttttaatgatacatgttttgtaataagcatttttttttagttgcagtgttctgcaaagacaaaacctgctgatacaattcatcctgttttagaaatctttgacccattcatcagactctgaccactctaaagataaaggattatggttgtattggtttttccgactgaagcggccttctgcagattgagaaattgtataattattaactgcggtaatggagatgtacttgcaagtttcatctggtatcttaatgacctttaaccctctgagtacacctaaaacatatcctagaattattgaaattaatcagttgtccataacttttctgtctgtataatttggctatcatacatattttgtttccccctgcccttgccagtttccatcctcctactcacatactcacaactcctataaattggagtatttagtagcagtagcctttgatataaacactttttaaaaatttactattttttgaattaatagggccactttctagtcaagtttttttttggggggggggtgaggagggtagggtaacagttctacacttacaagggtatttgtttagaccaagcttgttcaacccacagcctgtggggctgcatgtggtccaggatggctttaaatgcaacccaacatgagtttgtaaactttcttaaaacattatgagttttttttgagattttttttgagacagagtctcgctctgttgtccaggctggagggcagtggcccgatcttggctcactgcaacttccacctcctgggttcaagcgattctcctgcctcagcctctggcgtagctgggattacaggtgtgtgccaccactccaagctaatttttgtatttttagtagagacggggttttaccatgttggccaggctggtctcaaactcctgacctcaagtgatctgcccacctcggcctcccaaagtgctgggattataagcatgagccaccgcgcccagcctgcgattgttttttttaagctcattagctatcattagtgttaactgtattttatgtgtggcccaagacaattctccttcttccgttgtggcccagggaagccaaaagattagacacccctgatttagacaaataagtgaaggcacactgaaataacagttatatataataaccttgtgccacccagcgcggtggctcatgcctctaatctcagcactttgggaggctgaggcgggcggatcagctgaggttgggagttcaagaccagcctgacttacatggagaaatcccatctctactaaaaatacaaaattagctgggcatggtggtgcatgcctgtaatctcagctacttgggaggctgaggtaggagaatcgcttgaacccaggaggcagaggttgcagtgagctgagattgtgccattgcactccagcctgggtgacaaaagcgagaatctgtctcaaaaaaaaaaaaaaagaaaaagaaaaaaaaacacaaaaaaaccttgtgttttgtggatctcacattcatctcagatatttcttgccctgggagatcctctgaattctcaggactgcttcgtgtcatccctttatgctctactatcttcccctgcctagaaggcaagtagggctttgaatctcacctttgattctactgtgatcctatcaaatatagtaatgctagaaatataggtctgaagtttgggagagagattggctcggtatagatatgtaaagcacagttgtatatgtggtagttatatgaatgggattggatgaaattctctagaggtgtgtggaatggaaagaggtggcccaaggaggaagagagagagagagaaattggagaggtagaacaatttaggaaagagtaatgttctagaaactaaggagagagtttcacaactgcagtggtgaagcactgtgagttcttatttggcaatttggacttcattattgtcttatcacagataggaaatgaaaggttgcagaacatttaggagaaaatattaagtgaggacacagaagcagtaaatgtcgtatatgccttttaaacattttggagattacccatagtaggcctgtcccttgggtaaggcaattagggcagctttcctgggccctattttggggtggggaatgactcggggactttattatatgactttttttctgaacattaataaaattcagtttcaaaattttgtgattaactgtagtcctaagagcctacgaaaaatgcagataatgggcagttccacattggttgaactgccccaggcttctctcttctagagatgctgtcccttccttttaatcctgtagtagctcctatcactttttttttttttttttttttgagacagagtcacccagactggagtgcagtggtgtgatctcagctcactgcaacttctgcctcctgggttcaagcgattctcatgcctcagcctcctgagtagctgggattacaggtgcgtgccaccatacctggctaattttcgtatttttatgggattttaccatgttgcctaggctaggcttgaactcctgacctcaggtgatccacctgcctcagcctcccgaagtcctgggattacaggcgtgagccaaggctcctggcctcctgtcactttttataattgtcagtttgtttttcctctcagaaattaagctccttaaagctctctattattgttttgaattcccagggcctagcataatgcccagcacgtaatgtttagtgtttgttacgtgagtgattgaaggaataatccaatacatatctgtcttaagtacaaaagaattccaatatggtggtctcacagagtcaaaaaagcggaatgtttcagaaaagagggattgataaacagtttcaaatggtactaaaagtattgaaaactgacctttggatttggcttctagaaggtcattggcttccatagtgaaaacttttataacaaaatggttggagtagaagtggttgaagattaaaggagaaatgagatgtaagaaacaacaaacaagtttgtgggggcgggggggttggttttatttttaaagatttgtagctgagcatgacagtatgtatctgtagtcccagctatttgggaggctgtggctggatgacagcttgagcccagcagcttgaggctgcagtgagccatgattgcaccattgcactccagcctgggtgagagagagagaccctaactcaaaaaataaaataaaataaaataaaataaaataaaataaagatttgaagctaaagggaagaaaccattggagaagaaagccaaagatctgatggaggagaattcattatcatggtaatgttatgcatttgatttgcatatatctaagtattcccaccaacattttttttttttttttgagacagagtctcactctgtcacccaggctggagtgctggagtgcagtggcacgatcttggctcactgcaacctcctgggttcaagcgattctcctgcctcagcctccctagtagctgagactacaggctggtgccatcacgccctggtgatttttgtgtttttagtagagatgaagtttcgccatgttggccaggctggtctcggactcctgatctcaggtgatcctcccgcttcggcctctcaaagtgctgggattacaggcgtgagccaccacgcctggccccaaccaacatttcaagataatatatttctcctcccacttgggtttgacatattaatgtattttgaacttgaaggcttttgctgtgctatttggggcccctagtggtaaatctaataatgacatgcaatagaacagctaatataccagttattccttatgaaggttattctttctatgaggattaaatgaggttggaatatgtagttatagcaatagtagtgattcttaatcatttttttaaaaagagagtctcgccaggcacgttggctcacacctgtaatcccaacactttgggaggccaaggtgggtggatcacttgaggtcaggagtttgcgaccagcctggccaacatggtgacaccccatctctactaaaaaaactaaaattagctgggcgtggtggtagacggctgtaatctcagctactcggtaggttgagacaggagaattgcttgaacctgggagacaggaggttgtagtgagctgagatcgcgtcattgcactccagactgggtgacaagagcaaaactctgtctcaaaataaataaataaagggtctcactttgttactcagactgaagtgcagtggtgtgatcatggctcactgcaatgtccgcctctcaggctcaagtaatcctcccacctcagcctccctagtagctgggactataggtgttccaccactatgtccagctaattttaagaaattttttagtttttaaatttttttgtagagatggtggtcttactatgttgtccaagctggcctcaaactcctggtctcaagtgatcctcccacctcggcctcccaaagtgctgggattaccggtgtgagccaccatggctggccaaaaatgagtaatttttttttttttgagatggagtctcgctttgtcgcccaggctggagtgcagtggtgagatcttggctcactgcaacctcctcctcctgggttcaagcgcttctcttgcctcagactcccgagtaactgagactataggcatgggccatcacagccggctaatttttgtatttttagtagagatggggttttgccatcttggcctggctggtcttgaactcctgacctcaagtgatccacccccttggcctcccaaagtgctgtgattacaggcgtgaaccactgtgctctgccccaaaatgactaatttaaaggtgactgtaatatagttaaacaaatgcctcttttcccattctttactaacttgttatttaaatggggcaagtttttacaacataagaaacaggccaggcgcggtggctcacgcctgtaatcccagcactttgaaaggcagaggcgagtggatttcttgaggtcaggagtttgagaccagcctggccgacatggtgaaaccccgtctctactaaaagtacaaaaattagccgggcatggtggcacagactgtaatcccagctaatcagggggctgaagcaggagaattggttgaacctgggaggtggacgttgcagtgagcctagatggcaacactgcagtccagcctgggcaacagagcaagactccatctcaaatgaaacaaacatactaaaaacctattaacttgtttgatgtgagtgtgcttagctttatttcccttaaagagagtctttttttgagatggagtctcactctgttgcccaggctagagtgcagtggtgcaatctaggctcactgcaacctccgcctcctgggttcaagtgattcttctgcctcagccttcaagtggctgggactacaggcatgtgctaccacgcccagctaattttttgtttttagtatagacggcgtttcacgctgttaggcaggatggtctcgatctcctgacctcgtgatccacctgcctcggcctcccaaagagctgggattacaggtgtgagccactgcgcccggcctaaagagagtctttaggtgaaaaatttttgtgaatattgtgatttctccttaataatttcttgtgtatttatgaatttatataattaaatggcatatcaaaaaaatcacctatgttaattatgtttttgactcagttatattttcttttggtacattattaagttaatatccatatgcaaaaatatgctgacaatatattaattttggatttttcatttttatcagaaatcatgagtggaggatctcaagtccacattttttggggtgctccagttgctccactgaaaatgacagtatcagaagacacagcttctttaatgtctgttgctgacccctggaaaaaaattcagcttttatacagtcaacattctttatatctgaaggatgaaaaacagcacaaaaatcttgaaaactatgaagtcccagattctattggttctccagatctttgtggtcatttcttagcaaactgtatgaatagacatgttcatgtgaaagatgactttgtacgttctgtttctgaaacacagaatatagaatcccagaagattcactcctctagactgagtggcataactagctctaatatgcaaatatgtggatttaaaagcacagttccgcatttaaccgaagaagaaaagtatcaaagcttctcagtgaaaataaaattagagatgaacagcctaaacatcagccagatatatgtggtcagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagcgtttgggattattttcctcgaactcagtagataagtcaaggtctgaagcagcagttaagaaggtctcagaccttaaaatatcaactgataaagaatttctcagtataattacctccagccaggttgctttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtggcccagtctgaagctctatctagagtccttcaagtagctaagaaaatgaagttgatttctaatggaggagattctgctgtagaaatggatcggagaaatgtgtctgaatttaagagtattaaaaaaatcattaataaaaaactgtgattctaaaagccagaagtataattgtttagtcatggtgctatctccatgccatgtgaaggaaataaacataaaattcggaccaaattctggctctaaagtgcctttagcaacagttacagtaagtgatcaatcagaaactaagaagaaggtttttctgtggaggactgcagcattttgggcatttacagtgtttcttggagatataattttactcacgggtgaggtcattatggtatagtggtagcttattttataaagctaagttttgtttgtttttgttttctcccacttagtctttgaagactctttctttagtcatttgcctcttctgagctcagcataattgatccctttattgcatctgcattgctctcctttccattgtccactctcctgcccattgccacttctgggcctctgttctatccttctcagctctgccccttctttccacttatcccctcctttaataagccttccctagtcaggtggagtgggtcacacttgtaatcccagcactttgggaggctgaggcaggaagattgcttgaggccaggaatttgagaccagccttggcaacacagaacccgtctctacaaaaaataaattaagttttgcgtgcctgtagtcccagctacccaggaggctgacatgagaggattgcttgagcccaggaggttgaggctgcagtgagctttgattgggccactgcactctagcccaagcaacagagttagacctttctgcttctttacctaatgtctaataatgctgtgcacattgtgtttttactgtgggaacagttattgatttctgttgccttattttattatcaaaattatattaattacacttggaaatatggaaaggaaaaaactggtattataccaacttcatataaccaccaatagagttcgagagtgttgccttccagttattttctctgttctccttaaaatgtgtgtgcatgtgtgtatatatcacacatagaagctcatatttattgggagcttagtttgtgagaccctgttttagattttacatgcatatttcattacaacaagtatatgaggaaggtactgatttttatccccacttttcagttgaggaagctgaagcccagagaagtaaagtaacttgtccaatgtcatacatctaggaagtggcaaagctatagtttctcctagactccagaatttatactcttactatatagttgtaaccataaagaacattttgtttttttaatttttaatttatttatttttaagagacagagtcttgctatgttgccaagtgcagtgggtactcacgggcacaatcccattactgatcagcatgagaatttttgaattgttatttttaattttttgtttgtttgtttaataaggacaggatctcactgcattacccagtctgatctccaactcctgggctcaattgatcctcctgccgcagcctcccaaagtgctaggattacaggcgtgagctaccgtgcccatggtatttttaacatgcccttgtttccaacctggaccagttcacccctccttagggaacctgtggtcctccactcccaggaggtcactatattgatggcaagcttagtgcaaacacctgatcggctacaactctgaactcctgggctcaagtgagcctcctgcctcagtctcccaagtagccaggactacaggcacgcatgccgctgcacccagagagaatatttaatttttttttttttttgagacagtcttgctctgtcacccaggctggagcgcagtggcacaatcttgactcactgcaacctccgcctcctgggtgcaggtgattctcctgcctcagcctcttgagtagctgagattacaggtgcaagccaccatgcctggctaatttttgtatttttagtagagacggggtttcaccatgttggccgggctggtttcgaactcctgtcctcaggtgatccgcccacctcgccctcccaaaatgctaggattacaagtgtgagccaccgtgcctggccagaatatgttttcaccgaagacatctaacattgtgttacgtgttctttgttgatttaaaattgacacatggtgtattagagcaggaggaagttgattaagcttaataaaatatctaaagaaagaatgtgatacagaggcggtatttagaaaaagaaaacttcgaagcaatattgatagtcctaccaaatagtttacaggaggaatgagaaccttagctaatgtaccttggtgttcctgtaggattgtcaagtacaatctttttttttttttttgagacggagtctggctctggcacccaggctagagtgcagtggcgcgatgtctgctcactgcaagctctgcctcccgggttcacgccattttcctgcctcagcctcccgaatagctgggactacaggcgcctgccaccgcgcgcggctaatttttttgtatttttagtagagacagggtttcactgtgttagccaggatggtctcgatatcctcacctcgtgatccgcccgcctcggcctcccaaagtgctgggattacaggcgtgagccaccgcgcccggccgagtacaatcttttataaagaggtaaacacaaaattgtaatgaacaggcttagcatagccacatcccactggcaatattagctaatattatttatatgtgattatattattggaggttcaattcacctaactccctctgttctgattcagtgcttgctgaatacctctttgcttgtgatttggctttctagttgtagagctgcccacagcatgagaacaggctgaaatactgtttttttttgggcaattattgtaaatgaaaaaaaaatgttttttttctttaatttgtttcattaattgatttagtatgagcttatgttgcagagctgaaatctagttttggagtgttaacaaaattaagtttcccagactgtaaaagagggctggatcctggaccatggtcattttaccgaggcaattaatgtcagcagggacctctcaggggccttttccgttttcctaggtaggtgtaaactcaactctgcaatctctgtattttttcctaacatctctatagttgttaacgactaggtaacattctctctggtggctgtaatgcaatttacttaaccattttcctattataagacatttagatgatttctatgaactttttttaaaaaatcagattttttttgtctttttaagaaaaagaggatctagttcaccgaattctgaataagtttcttttgtgtggaacagatggaaatgttgggaaaaaaaagaaatctacacttttctgttgtcctaatgagtcagtgaacttagttggatagcttgggtagttcatactacctattgatatatacccccaaacagaaatcttcctttttttttttttttttttttgagatggagtcttgctctgttgcccaggctggagtgcagtggcgtgatctctgctcactgcaacctctgcctcctgggttcaagtgattctcctgcctcggcctcccaagtagctgggactacaggagcccgccaccacgcctgactaatttttgtatttttagtagaggcagggtttcaccatattggccgggctggtctcgaactcctgaccttgtgatctgcccaccttggcctcccaaagttctgggattacaggcgcgagccaccgcgcccggcccatactgaaaaatttgaagtaacagatgtattccagaccttgttgaataccaacacagtagacagtttgctattataacttctagcaatagaatgaagagatgccaaaaataaggattacctaagggagactactgactagaattagaagaagatgggaggcttaacattgggaaaccacagtgtttaaaggacaaacagaataaggactaggagctggggcatgtcagtgagagggtaggaaggagccaggaggccagggcgggctacccatcccctccatgcaccactagtgattactatgtcactaatccaacataggcttcacagtcctagctttcagaatgctctccttgaaatttcttgtctgttccttttttctgaagaacatgcatcctgaatgttggatcatgaaaagtcttgaatgctgtactagctcttcctggctaggcagtggggaaccactgttttttagtaagtcacctgaactcattaatgctctgatatatcactcgcctgaactcattaatgctctgattaatgactcattagcattgtaagaaatgggttgcaggcgggacaagcacctgttgggagggaaaggaatgtgtaatgtaaaacagtagtagtggtggggcatgggcacatttaagcagcagaggggtaggtgggagctggtggcaaggagtgggaagggagaggcaagatgacttcagattttagtttacttgattagcagcatagcatcaacaaatgagttgggcgctatgaaaggaaaagcagatttggacattgctgagtttggggagccaatggaatatccaggtgggaatttccattaggcagttgtagataaaaggttcaaaagctgaggaaagggtctggaatctaaatctgtaagtaatcacttggaatttatacatccttggttttctttcctattatctctaaattatttcactattgttaatatacgtttatacctctgacactgtatgctgattagatcctgccttagagatagctcccttcccctctttctctttacagctcacacgttttgctctacctacaattgtttctacctgttggtatgtttagttctacctgattctactctatccgccttagatatacagctctctctttccagttggaaaatgttccctacctccaaagtctttcacttttaacttgtgtggaagataattatcgtgctatttagggaaaaataatcaagtatgttaagaatgccttatattcagatatatttatagtagaagggaccagtgcatactgaatattattactctcctaggcactacggctttggaaccactactttgccttctggtcctaaaaaaaattatttttgatgtatcagaaatatacatgataacattttccttatgtaaataaaagctattaaaccttttttatatagagcagtggacttccatactgctatcatttgaatataaagaagcaattttgttaatttacctagatttagattttagatttgctgttttgtcatttcgtgcccttaggcaggttatttaacctatttgatctctagttgcttggtatatgggaggcatgcataatattttgctgtgactagtaggttaaccacattgtgaaggaatttatggcatgatcagaatgtttttttctctctctagatgttgttattcatgaggaccaatggattggtgagacagtactacaatcaacatttagcagtcagttattaaatcttgggagttattcatctattcagcctgaagaatgtaaggcacattttaaatgaagtaatgtattagtgtttaaagtataaaaacatactaggaaagattagagttaaaatggttcttttacaaaatgttttctaaacagttggagagtattggtttcttttcattagtaagaatgaaaatagaattttaagaaatgaacttgtacattgtaaatcacatttattttaagaagtattgggtatcatgtttcgttttcttaggctgtcagtatagtggtggttcttcaccttttagggagtcagagacctctttgagaatctatagaccatttctccagaaaactggacttatgtagataggcacaaaattttgcttataattctaaagcattccgtggacctctgaagttcttctgtggaacttctgagcctctgattaagaatccttgaggtaataaaaatgtattggtctcgtattcagacagctgtggtttgaatccttattctcctgtctaccactgctaagaaaagctatctttcttctttaatgtccagttttctcttctttaaaagaagctgtttaatgaggaaactagcagctatctcctccactaggaaataaaatgacataaaaaaaagaaagaaaacaaagtaagggaaacagtataaacttgtggttttggtcactggactcagatagaccaggatttgaatcctggccctcttacttccagtctttgtctttaggcaagttatttcacttcactatacctttatctccttttctgtgaaatggagataaaaatacatatataccttatagggttgttatgaagattaagtgagaaaatgaatataagatgttgaacctgcacataatgtagtagtaacatagtaatattagagggagaaataataagctagcaaaatatatttgataaaatgctgaagtatcatacaagaaaatagctagagaaatatactgattatacaagaagataactggaataataggaaagttataggatgtatatggaagatagagcatggaattccaatctttgaattcttaaagaaaggcagagcaagtagaagggaagagcaacaattagaataacaagaactgtgtttgggatgggcaaggtttcattatatactagggtggcccatcagcagaaaaccaactctgacatatttcatagacaactcaaatagagttcttcatctatccaatatatatttattatgtgttgacattgtttcaggcactgtgtttactgtacactgggggtacaatggtgcctgtcctcctggagcttatgttctcatgtggaagacagaccaaaaaaaatgaatgaaacagacatataagtaaaatatttgcaggtgataatgagtgctatgaaggaaactaacaaagggttaagatacagaatgccatggttctagttgagaaggattgatcatggagtagaatcagggttaggaagttgttacaatagctgcagttgagagataatgggaggccagtggagctaaagagccgagatatatttgtaaatagagttaataggattttctgatgatgtgggtctggggatcagggaagagggacaatctactgctactggattactggtttaagtaactaggtagcctttattgtgaaagactgagagggaactggtttgtggggaaaagggctatgtttcaaggcatgttaagttttagatatctttgagatattcaagtggagatgtcatataagaactggaaacaaagttcaggactcagaagacaggtttaaaattaagaggcaaattttagagttattagcatacagataatatttcaaatttaaaagtttttaaaataaatattatctgtataattatagaatcacaggggattgcaaaaataatacataaagtcccatgaactcttcttctagcttctcccaatggtgatatcttatataactttagtacaatatcaacaacaggaaatcaacatttgtataatactgttaactagtaatatactaggatactttccctttcagtatcaataaatatagtatcagcctggcacagtggcttatgcctgtaatcccagcactctgggtggctgaggcaggaggattacttgggcccaggagctcgacaccagcctggatgatatggtgaaacctcatctctactaaaaatatggaaaaattagccaggtgtagtggtgcacacctgtagttacagctactggggaggcttaagtgggaaagaaagttgaggctgcagtgagccatgattgtaccacagcacttctgcctgggtgaccagagtcagaccttgtctcaaaaaaaatttttttcttaaataaataaatatagcatcaatacagcattataatatgattaatactatatcaataaaatagatacttagtcctaatgccaatgtcttatttaatagaaaagcactcgaggcattgtcattaaaaccaggaaaaagataaggatgtccactatctctgcaactattcatcttatactagaattatcagctaacgcacttagacaagaagaggcatctggtctggtgcggtggctcacgcctgtaatcccagcactttgagaggccaaggtgggcggatctcttgaggccaggagtttgggaccagcctggccaacatagcaaaaccctgtctgtactaaaaagatgaaaaattagccaggtgtggtggtgcatgcctgtggtcccagctactcaggaggctgaggcatgagaattgcctgaacctaggaggtggaggttgcagtgagcacctgtacactgcactgcagcctgagggacagagcgagattctgtctccaaaaaaaaaaaaaaaaaaaaaaagaaagaagaggcatttgaacatttgaatggataaagaagaatgaaaattatctctatttacaaatgctctgataacatacctgaaaactccagggaatcaaagttaaaacaaatttaaataataagataattcaatgatataacaggatgcaaaattaatgttaaaaaatatcattaggctgagtgcagtggtttgcgtctgtaattctagccctttgggagatgaaagtgggtggacagcttgagcccaggaattcaagaccagcctgggctacaaaaaagaaaaaggaaaagaaaaagaaaaagaaaaaaatgctgggtgtggtggcacacacctgtggtcccagctgtttgggaggctgaggtaaaaggattgcttgagcccaggctgggggatgaggttgcagtgagctgtgattgcaccactgtactccagcctgggcaacagagcaaggccctgtctcaaaaaaaaataataataatagtaattagacaatatacacaaataacaaacagagggcataatgatagtgaaaaactcatttactatagtaataaagaagatagttcaaaatacagttaacaagaaatatgcaaagcctatatgaggaaaaaatttaaacactccagaaagaaatgaagacatgaataaatggaaagacatttcctgttcttggataggatgactcaacattataatgatgtcagttcttcctaagttaatatgtaaattcaatgtagttccaatgaaaatatatgtgttgtggcatataaaagttgatactaaagctcatatgggaaaacagacatgcaagaatagctaggaaaagactgacaaaggaaaactacagaggaggggaactagctttaccagatgttaaaacatactataaagcctctgtaattaaaacagtgaagtactgatgcatgaatagacaagtagaccagtggaatagagtaagaagattagaattagacccacctacatatagcaatttaatatatgacaaagatagtatctggaatcagtgagataaaagctaacttcttaataaatggtgctgagacaactgggtagccatttggaaaaaagggaaaattggacacgtatctcacaacaaacagtaataaacaccatatggattaatagtctaaatgtaaaaaataaaatcatgcaacaacaagaaggaaacctgaatgaatcctctgtaatcttggtgtagggaaaggctttttcttaatattactcagaatccaggggcagtagaagataaactgatacattttactgtagaaaaataaattttgcataaccaaaacactataaacaaagtcaaaagacaactgacaaacttggagaaaatatttgtaacatacaacaaaaggctaatatccctaatatataaagaacttttaaaccttgagtgacaaagtctgggtgtggttgttcacactggtaatcatagcattttggaaagctgaggtgggagaatcacttgagctcaggagtttgagtccagcctgggcaacatagtgagaccctgtctctacaaaaagtcaaaaaattagccaggtgtggtggtgcatgcctatggtcccagctacataggaggctgaggcaggaggattgtttgagcccaggaggtcgaggctgcagtgagctgtattcatgccactgcactctagcctggcaaaagggaaaatgtgaaaaagagatgaacagtcaattttcaaaaaaagatataaaaatggctatcaaatataacttattagagaaattcaaattaaaactacatggagataccatttctcacctatcagattggcaaaattaaaaaaaaaaaaagcacattctgttggcgcaactgtgaggtaatgtgccctcttatacattggtggtaggaatgcaaattgctacaacccttttgaagggatatttggcaatatctaacaaaattacatatgtacttagctttcaacctagcaatcccacttctaggaatctaccctgaagctacatctccaacaatatgaaaatacatatcacaaggttattcattgcagtattgtttataattgcaaaatatataggagaatgattcactaagttatggtacattcacatagtggaacactatgtactatgcagctgtacaaaaagaatgaaaaagatctctacgaactgatatggagtgattcccaggacatactgttatgtgaaaacataaaccccccaaaactgtatgtagtatgctgtccttcctgtaagaaggattggaggaataagaaaatacctctgtttatttgtggaaagaaaatgcaggaaggataaaccagaaactaaagagattggtcacctacagggggcacgtaggagaggggtggaagaaagtggggaatgggaacaggatagcaggggtcaggaggaagtgacactaacaaatgaatgtattattgttacaaatgaacccaatattgttacaaatgaataaaataactacacagaagggggtggggaagaaaagaacaaacctaagtagctgtggaaaagagtatattgactggattctataaggctaatgacagaaaggactgtacataaatgctgcaatctagttagaaatatgtttctcaaaggggaatggcttagcaataaccttatgtacatactagaatgaacaaatgagtacatagattgtagataaggaaagctggatttctcactgttggagaaagaaattataaacaagggaaggttaaaacgaaccagaggtattgttataaactgaggatttttaatatagataaatggatacagaaatataggcatgtgtatatgggtgggatagtacacatacataaacatctcctagttctgtccattgagcgagcacagcacagatgcagttactccccagtaataatgagcatacctggtgcccagatcttcgtctgtaaacattttcttttcttttctttttttttttttttgagatggactcttgttctgtcacccagtctggagtgcagtggcgtgatcttggctcactgcaacctctgcctcctgggttctagcaattctcctgcttcagcctcccaagtagctgggactacaggtacgtgccaccacgcccagataatttttgtatttttagtagagatggggtttcaccatgttggccaggctggtcttgaactcctgacctcaaatgatctgcccactttggcctcccaaagtgctgagattgcacgtgtgagccaccgtgcccggcctctctttttttgagacagggtctggctctgttgcccaggctagagtacagtggtgcgatctcggcttactccaacttccgcctcctgggctcaagccagcctcccacttcagccttccaagtagccggcaccataggtgtgcactaccacgcctggctaatttttgtatttcttgtagagactggatttcaccatgttgctctggctggtctcggactcctgggcttcagcagtccacccatcttggcctcccaaaatgctgggattacaggtgtgagccattgtgcctggccaacatagttctctaatgaaaggaaccagctctgctaaaagtggttgattacaggactgggtcagggcaaattcaggataagcctggaagtctagtggtgccagacaagacatgttgaaataatgcaagagccaacctgaaggaacacctactggctaaagctgaagcaatttgagtaagaaaataatgatagtattggattagaacccatagattaaaatctttacaaatccttactgatataaagacatatttatttcattaactaaccagaggggaagagagagctcttccttccaatggaattccaattaataaatctgagagaaaagaaaaaaaaatagagaattactggccatgctcagtggttcatgcctataatcccagcactttgggaggctgaggcaggtgggtggcttgagcccaggagttcgagaccagcctgggcaacatggcaaaaccctgtctctacaaaaaatagaaaaattaaccaggtttggaggtgtgcccctatggtcccagctattcgggaggctgaggtgggaggattgattgatcccaggaggttgaggctgcagtgagccgtgatcatgccactgcacttcagcctgggcaacagagtgagactctgtctcaagaaaaaaaaaaaaatacaaaacacaaaaatagagaattaccatcaggcagagatcacaataataaatactgcaccgacacaaatgcactgatagatgctaaaattagtaggtgaaagtctgaggagagagagcattgcatagtctcaaagtatctccccaggataccagcttactagagggaaaataataaatttataagaaaactcttcagacaccaagttaactgagtgattggggtaaatatcaccagtaataagatgtatggtatcataaattctttgatattatccattgagaaggatccaccatattttttgtggaattgccaaaaatgcataacttcattccaatcataaaacactggagaaacccaaagggaaggacgttctactaaataaatgatcaggattcttcataagtgtcaaggtaatgaaaaagaaaagactgagaaactcttatagactagaggagaccaaagagaaataacaactaaatgtgaggtgggatcttggatgaaatcctacatagaaaaagcatattaataggagaattggtaaaatttaaataacatatacattttaattaacaatatttaattaacgttagtttcctgtttaagataatttataatatgtgagatgcccacattagtcgacatagtgaggaatataagggaactctgtactatttttgcaacttttttgtaagtcttacattagttcaaaacagagtttttaaaagagctgtatacgatcatctcaataggtacaaagaaagcttttgataaaattcaacacctgttcattaggaatagaataaaattttccttaacttcataaagagtgtctttagaaaacccagaacaattatcatcctaattggaaaaatattagaagcattccttttaaaattcaggaatatgactaggatactactattactacttttcttcaacaccatattagagttattaaccagtgcaataaacatggaaaaatagatatgtaaagattggaaaggtagaaataaaactgccattattatagatggtttacataccttttccctctgaaaactacaaacaaattatcagaaataatgtgaaaatttagcaaagtagctggatataagattaacatacaaaagtcaatcacatttctagagtagagcgactaacaataacaaaggaagctgtcattgacaacaatattattttgtactaatagtaataaatgtaacaaagtatgtgcaagacctaaaaaaggaaaaatttttaaatgaagaaaaactaacaaagaatgaaataaacatactttattcattaattggaagatttaacattgtgaagatttcagttcttttcaagttgatttgtaaattcagtgcatgttccataaaaatcctcgtaagatttcaagggcgcagtggctcatgcctgtaatgccagcactttgggaggccaaggtaggaggatctcttgaggcaaagagttaaagaccaataagattttcatgtaatttgataagattatatgatatttatgtagaagagtaagtggttgaaaacagcagggcattttaagaagaaaagcagggaagaataatttaccctatcagctatcaagacttagtatgaacctatagtaactgagatggtgtggttttgcccagttgaagtcagttaaattttaattttgagatttctgtaaaagatacaagtttagtcttttattatgtatatttgaaggtgttacattttggaaagtgtgtgtgtatgaatgatagctaaatggcttctaagtaaaattcagcatatcttgtagatgttgatagaatagaaggggaaggaatgttttgaaataatgaaaataacatggtatgcaaatgctttgcaagagatttgggaaatgtagatatctctggttttaaggatgatctagattcaagtaatagttcagtaatttcataaaactcttatgacaaaattctggatggagaatattctatgaatcccctagagagtttcaggtttttgtagaatgatgtgaaaaatcttgaactaattagataatctttagaagttacttcacaatctttgtttttacacatacacaggaatttatggtgctttattttttacaagttagtagctaaataaagtatattctaaagttttttattgatgtagggaaatggctaccagtggacattttgagaatattgcagttgttttccttctgaaagagtaaaccgggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtggggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccgccgccgccgcggttgatgtggttgggccggggctgaggaggccgccaagatgccgcagtcaaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatctttaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttggaaataagaaagacctgcatatggaaagggtgatcagttatgaagaagggaaagctttggcagaatcttggaatgcagcttttttggaatcttctgctaaagaaaatcagactgctgttgatgtttttcgaaggatgattttggaggcagaaaaaatggacgggggcagcttcacaaggcaagtcttcatgctcggtgatgtgattctgctgcaaagcccgaggacactgggaatatattctagctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtgtttcttaatattatgaccaagaattttatcggcattaatttttcagtgtagtttgttgtttaaaataatgtaatcatcaaaatgatgcatattgttacactactattaactaggcttcaatatatcagtgtttatttcattgtgttaaatgtatacttgtaaataaaatagctgcaaacctcaaaaaaacaaaaaaaaacaaaaaaaagagtaaaccaatttggttactcattttaccaatttggttttgattttgcaagtggttacaactcatgagaggattcttatttctgatcaatatattgtgtttttggaaaggacttctgggaaataattatgatgaagccctcgagcaattgcaacaaaaccaaaaattgaaaagtgggacctaataatacttttttaaaatttattttttagagacaggatctcactctgttacccaggctggagtgcagtggcctgatcatagctcactgcagcctcaatctcccaggctcaagagattcttctacctcagcctcctgaatagctgggactacaggtgcatgcccccatgcccagctaatttttgtattttttgtagagaccaggttttgtcatgttgcccaagctggccttgaattcctgagctcaagcgatcctcttgtcttagcctcccaaagtgctggaattacatgtgtgagccaccactcccagccccagaacaactattattaaaaagtcaaaaaacgacagatgttggtaggctgtgtagaaaaggaaatgctcgtacactgttggtgggaatgtaaattagttcagccgctgttgaaaacagtttggggttttctcaaagaagttaaaactgaactatgatttgacccagcaatcccattactaggtatatatccaaaagaaaacaaattgttctaccaaaaagacataagcacttgaatattcattgtagcactattcacagtagcaaagtcatgcaatcaacctaggtggccatcagtggaggattgaataaagaaaatgtggtacatatacaccatggaattctacacagccataaaaaggaatgaaatcaggatggtgcggtggctcatgcctgtaattcccacactttgacaggctgaggcaggcagattgcttgagtccaggagtttgagaccagcctgggcaaggtggcaaaaccctgtctctacaaaaaatacaaaaaaattagctaggtgtggtggtgcacacctgtggccccagctatttgggaggctgaagtgggaggatcacctgagcccaggaggtggagtttacagtgagctgagattgtgccactgcattccagcctgggcaacagagtgacaccttgtctcaaaaaaataaataaataaataaataaattgcagcaacacagatgcagttggaagcaattatcctaagtgaattgagggaggaacaggaaaccaaataacgtgtattctcacttataagtgggagctaaacactggctactcatggacatagaggtgacaacaatacacactggggactactagagggagagggttgaaaaactacctgttgggtactgtgctcagtacctgggtgacaggatcacttgtaccccaaagttcagtatcacgcagtattcccaggtaacagacctgcacatgtacacccgaatctaaagtaaaagttgaaaagaaaagacttctgttctttcatctttatagtgaggtgttacatgttttacaaacctagttctgataatgtgacaggaatataaatttatcttgaatattattaaatatataagtcaaagatcaacacagtgtttccatgaggtagactttttttggaatctaaataaccatgtgtttccatgtaaatttttatgaatcagggacaaatatataatttgatgtcagagatgtttttgttccccaaaagctctatcttgttcatgaaaaacgaagcccagagaagttatgtacaagttcacagagctcattattgacaaaaccagaatttgaatacaactcttctgattccagatttgctggaaatactgtgaaagaagaattcagtctggtagtattacgtgtggttttaattttttctttgtaactttagtttgaattttatgtgtgtgtgagcatctgcatttacttttaaaaacttttattgtaaaagccttcaaacatatacaaaagtagagaatacaaagcataatgaacttaagtacctattagccagcttattaaaacatggtcagtcttgtttcacctgttacatcccttttcttttactgtctaaaggaaggaaagaagaatcacaaatcagtttatgaagtctgctttctaaaaagtacttaagtgtttattgccaatatcttattttggtcagcaatcaatcacgtactcaagcatacttctcttaccttcagagaaattaaaatttaatcagcaaaactcatcagcctgtacatttaaaatatatgcatgttattgtacagaaactataccttaataaaaagtgagaaaaaaaaatgagacaggaaagagaaaaacatttaaaagacatagtaactgaagaattaaataaccaatccaacacttgaaaaatattacaatgtagcacatgcttaaaagctctctgagctcagggaaaaaagcagcactgtgaatctatagtggtcatcattctatgtggtattgggtaggacaagaagacagccttgcagctggaaattggtgaggacggaggcctcgtgtggaaagagtaaggcacactcagggagagaaccagtgaggtggctctgagcctgtttcagaaggggcttgaggaagaacggcagaggctaggatagttgggaaagcaggatcaaatcagactccagggattggggaaccaattggctgttacagggtggtggagtcaaaaaagaacagaaattttgtgtttggttaattgatagaaaatgatattattaacaaagtaaagaagtatgggaacagcacaagttttttggggatagtaaataattccatttccattgattaaaaatatcaagtttatttttacatctaaactgattcaagacttagctattgtacatgttttagagaaaacaaaactatattttatatctaatcatactttacaacataaaatacagttctaaaaaatattatttgtcaagaaaaatgtaatgttgccatcttttgtctgtatgcatgttttttttccttagattccagtgtagttagtgacgttgtacttcaagacttactggcatatgtgtcctcaaaacattcctacctcagagatcttcctccgagacagcctcagagggtgaacagtatagactttgtagaattggagcaccttcaacctgatgtgttagtccacgcagtactaagagttgttgatttcctatactgacaggtaaacattttgactgcctccttaattttagattatgaaaaaattaagatacaagaccatcttagtgtaccatttggttatcactatatatgtatcatcagctattaaagtatggtatcacgtgtgatagagtaatgccaactaagatactcattttccttttccagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggtaaatacaccaaaaagcatttaacctatttatatttcggtaaatgattaatgtttatgagcccaagatggagaaaatcttaagagacgagacagcatttgaaatacaagtgatcatgattgaatattcttctgcaaatttcttctgttaaaattttgtacctcttgtagcaattcatttatctaataagtcttcattaattaatggtggtgaaataaaggcttaaatttattcccagatatactactttacctttttagtgaagatcttacctccttcaaataatgttctttaaacatttaattctggagaagcttctacaatttttttttcagccagagtactctgataaataaatgctatgattataaggcagatgtcaagggagttaccttaactctttcaagtcacaattaatgttcaataaattacagtttcatatttttattatagttgttttaaaagcatgcactgttagccatccctagaatgttcagtgttaaaatatgacccatgattacatttttctttaaagcataaattatttctggtatattgaattaaatggaattgatgtttcattaaaatagtatagtgtcttccctttgctcttgtgagatcctttagttgtaacaatcaaagacagtttcatttgtggcttatgagttatttttccctgctaaattaatttagagattgattcagtatattattattttttacctgaaagagttaatgtctctccaaacttctgccttccaaatagttatttgtagataggatctatcacattgtctctcttaatcattaatagctatgactaggatttgagataagtctaactttggacttttatgttaagatcaaacagggacagatgtttggttgagcaagctgacaaacatgtatcagtgatagactaactatgatcattgaccaccatagcctggctgagaacatgagtctagtgcatgctacacaagaatgtaggtcacaggtatagtggagctgtaacagagcagattgctccatgtttaatgtgaatattcttttaaaattaatagttttttggttaatagaagagaaattacagttgtctctaggtgactctatggtgtttaggttagtattgaaaacgtatgaatccaggaattaagatgttgttgttctttgtacattcattcatccagccccccttatttgtaaccatcattttaaagttttaacatctacttcaatacctcacatcagtctttttaagataaaaataccaattttgaaggattacttaagtaattctattttcctgattttacttttcttttcaagagaccaaccccatttccaaattcccagcaaagagaatctgattgcccagagtaaatttgattcaaaaaactgtgatcaggaagacagggtcacgcaatacaaatatgagagcttgagcttatttcagtggatgggaaaacagttaagggaatcatttgtgatctgggtgaatacataaagatattcactaccaaaaatgtgtatgttcattagcttagaaagatatatgtaatgtattatttagtttaaaaagtagattataggccaggtgtggtggctcactcctgttaacccagtaccttgggaggctgaggtgggtggattgcttgagcccaggagtccaagttctcatcttaaaaaaaaataaaaaataaaaaaaattggattgtaaaacttcatgtatagaaaatatattatgttatcatataataaatatttttatgtttatataagttaatacacaaaaattttcaagaaaaccctttatatatgatagtatctcattttaataaaaatgtatctataagtacatatgtgcatttgaaaacctggaaatatgcatgtatagcaaaatgctagccgtagttatttctgtatagtagtattatatgtgctttaatttttttctttatacctttagtttgaatttcatatgtgtgtgagcatctgcatttacttttaaaaacttttattataaaagccttcaagcatatacaaaagtagagagaatactaagcataaggcactttttttttttgtttgtttgagacagagtttcattcttgtcacccaggctggaatgtagtggcatgatctctgctcactgcaacctccacctcctgggttcaagttattctcctgcctcagcctcccaagtaactggaattacaggcatgtgccatcatgcccagcttatttttgtatttttagtagagacgaggtttcaccatgttggccaggctggtctcgaactcctgatctcaggtgattcacccgcctcagcctcccaaagtgctgggattataggcatgagccagccaccgcacccggccagcataatgaacttcggtacctattagccagcttattaaaacatggtcagtcttgtttcacctgttacctccctcatctttactgtttaaatatttcacaataaatgtattttattttataattaaaaataaaattaaaaccttatgctttttaaaataaaagaatagttaatgtttggaaaatctagctaacaatgtgagaaaaaatagaattaaatttatactttatatttgtgccaatataaatttcagatacattagagattcaaatacaaaaataatgaaacaatgaatagtagaagaaaatataggcaaaattatttgtaatgcaaaggttggtagggtaaataaaatccaggaacaaaaactattatacataaaaaccaccatgtacaaaattgaaaggcaacaaaaaaaaaacagaaaaaaaattacattgtcagacaataatgcagtaagcaaaagacacatatctatagagttaaatggggaaaggatatgagtaggcaagtccccaaagaagaaataaaaatggccaataaatatatggaaaaattgttcttacaagtaattgaaaacacacaaagtaatgatgatagattatttttcttttaagaaattgattgagaagatatgggaaaacagctactgtcatcagctattggaaatgcaaactggcagaacctttcttgaggataactgacaattaatatgaacaaattgggggtacttttagcccaataattttagctctaggaacttatcataactatgtataaagatgtagctgaaaatgggtttatcatggtatcatgtataattgtgaaaaataaaaaacaaccagagtccctcaaaatagaggtttgctgtaataatttttaagattttggtgtatctggacaatggcatattatgtaatatttaaaagcaatgtagaataatacatacatataaaactatatttgacttattaagtcaatcccaataaataaaatcccaaacaactggttgtccgctaaaatgttaactgcttatttagggtgttgagattatggctgctatatgtttatttacttggcttctcttagcttacttttctaatcaggtattttgtaataagacaagaaagctattttagtgattggttttaagcagtaacttggaatatatgctttagttctagctagtgatgttctgtctttacagatttactgagatgtttgatgattttccaccaaaaaaaaaaaaaaatctttagtgaaagaaactaaggagatgagcaggtgtagtaaattagatttatggcctgaagtgagaaactaaaaagacagctgatgttatcagaaaaatgagtgctaagaaaccctcttttgttttattatagttttgaagttgaatttactaatacagaatatgataatacagataagttgaatttactaatagagaatataacagtaacaaggtctgtgttactgtggctttaagtattagaattgtggccggcgcggtggctcccgcctgtaatcccagcactttgggaagccgaggcgggcggatcacgaggtcaggagatggagaccatcctggctaacacagtgaaaccccgtctctactaaaaatgcaaaaaaaattagccgggcgtggtggcaggcgcctgtagtcccagctactccggaggctgaggcaggagaatggcttgaacccgggacgtggagcttgcagtgagccgagattgcgccactgtgctccagcctgggcaacagagcgagactccgtctcaaaaaaaaaaaaaaattgttactgagagttaaaaataagtactattgtgtctaaatgctttttgttctagaaaagttaactaagataactaaagtattgaaatatgagtgaaatattagacttgggttcatttcagtgtcctttctttaacaaaacaaaacaaaactttgcctatagatagatacatgagaattttctttacagaaagcagttggttattataaatgatgaccgttcaggagggcaaggaatctttagaaaatattttattaaaattatctctggtggcccggcgcggaggcttatgcctgtaatcccagcactgtgggaggccgaggtgggcggatcatgaggtcaggagttcaagaccagcctgaccaacatggcgaaaccctgtctctactaaaaatacaaaaattagccgggagtggtggcacgcacctgtaatcccagctactcaggaggccgaggcaggagaatcacttgaacctgggaggtggaggtttcagtgagccgagatcacaccactgctctccagcctgggcaacagagcgagactctgtcttggaaaaaaaaaataataataataatctctagcatgcttctgttgtcttaatgcaccattcatattttgtctctgtttacccaaattctttagtgataaaagattagtattcaactgacttaatcagatcaatctatttaatctgatactaagcctagattttttttcctttttggtgacttttgtttttactgtttttgtttaaggttatatttgggaatttaaatatctttttgttcagcgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggtaagatttttatatacataaattctgctatttttatttcttttgaaacagagtcttgctctgttgctcaggctggaatacagtggtgtgaacacagctcactgcagtctccacctctcaggtttaagtgattctccccgctcagcctttcgcgtagctgaggagggaagggaaggctagtgcataccatcagtgcatgccaccacacccagctatttatttatttattattttggcagagacagagtctccctatgttgcccagtctggtctcaaactcctggactcaagtgatcctcttgccttggactcccaaagtgctggaattacaggcatgagccaccacacccagcccactgctagttttaatataagcaaaaaggctaccacttgtggtaaaaatgtataagtctatataaaagtgaaatataaatctttgcaaatatctgaactagattccagtagttttaggaactatgtgctaggaaccagggacaaagagcaaatacctattttttattatatgacaagtgggagcagaaattcagatccttactttatcttggccaaatgccagattaaaatgttactagttgggttaattcacatatatgtgtaaatatgttttccaatatatgattgaagggttagcattgttatatcataaaactatgctaaggagaatacaggcagaaaacaaagacaatacctctcaaaaaacccaacttttaattgaatacagagatttcattctcagagaagaactccttattcttagttctacactgaaacatttactaataccagcagatagtttaaattaataatatttctggaaggtaaacacagatgatagaaaatttataagcttttatactataaaaatttcatactattttcaaaaatggaagttgcctatggtcataaaagactctagatttatactaactggtaaaatcttggtaatgttatagcatcatgtaagttcctaagccagttttatatttatgtgcccctcccgtgctctgcttctccaacttcacagacatatagaggtggtcaccacaggaaggaatgccagacacagttgaggggctaccttactttgcagagacgtttagtttggtgccatggagaagtcaactctgttatttactgcttacacaaaacagttatctgctgggattgaagtctagaattaggtttaaaaataaaaataaataacatcatggacaacaacaaaataggaggccaccacgctgatgatgaaagattctcaggctatagccccacttgtttgaggacgcagccaggaattgtgcatgttcttggaagtcctggaggtgtgctcctcattagcaagccatgccaaaactgtgccattaaaatcagtccttcagaggctttgttcacagaggcctgtttagcctttttcattctctttatgttcagctatgagggctgaattcatagtttctgtcatagtgtatgtgtttttaagacaaaaatggagagagaatatgaaaacacaagcaacttttccctaacctattttatagttaaataaaaggagaaagagagatcagcatgggagcatttcctagaagggtctgcttgctcaacaaaagccagagggggatgaggctaggcctgagtccttgtaaagaaatgaagacgcttacccagtacctcatcttaccgccagcagaatttcagtgctcagcggagtgacccccttgaaagcaaagtccacattcagcgtgaccttttaattcttttcaagagttgtgtaaatttacaaaatgataggattatgtgaacattcttttaaaattattgaattattacgaattttttaggctgggcagggtggctcatgcctataattccagcactttgggaggccgaggtgggtggatcatttgaggtcaggagtttgagaccagcctggccaacgtggtgaaaccctgcctctactaaaaatacaaaaattagccaggcatgatgtcgggtgcctgtagtcccagctacttgggaggctgaggcaggaaaattgcttgaacgcaggaggcagaggttgcagtgagccgagattgcaccactgcagtgcagactgggtgacagagcaatactctgtctcaaaaaaaaaaaaaaaaaaaaaaagactttttgagtggagggaggagagcaagggttgaaaaactaactgttgggtactctgcctactacaggagactacttgggtgatgatatgcccatgtaacaaacctgcacatctaccctctgaatctaaaataaaaatcgaaatttttttttttacatatttttttaggccagacacattggctcaagcctgtaatcccagcattctgggaggccaagaagagtggatcacttgagcccaggagttggagaccagcctggtcaacatggcaaatccccatctccacaaaaaaatacaaaaattagccaggtgtggtggtgtgtgcctgtagtcccagctactcaggaagctgaggtgggaggatcacttgtgcccagggaggttgagactgcagtgagtcaagattgcaccactgcactctagcctggacgacagagtgagactgtctcaaaacaacaaaaaataataattttgtagtgatttaacatgtctttggaaagatgtggtattgaatcttctacagtttgttacatattcgatcgctacgcactcctgctaactcatgtagggatatgtgacacaattggaagagatgatgaaaccgtctttgggcattgaaagactaaagcaaatgaagttaagaacagaagactcatcattaactggactctgaaagagataaccagaaaacagtaggagactagagtgattagttcttgacctggagtgttcttacttctaagtggatgaagaagaacaaatttgaaggcttaaggcttaaagaagcctttaaattgactatggagaaagggagaataatgctcaagaaaactcatagacctcaccagtacacagtaagacaaaagtaaattaggaaaaaataatgtctgggagatagtagactttcagtatttgtttactggtgaatggatgagccattagcagtgaattatgaatatgcttgaggtttcttgtgagtcacctgagaaacgattaataaatgagaactttttataacccacagccagagtatatagatgataatggtgagcggaaagttggaaaaaagtttaaaagagaacaggctattgatatttttacgtagagagaagaagaaaagttcacctcctatttggctttttttttttttttttttgagacggagtctcgctctttcgcccaggccggtgtgcagtggtgtgatcttggctcactataagctctgcctcctgggttcaagccattctcctgcctcagcctcccgagtagctgggactacaggcgccagccaccgcgcccggctaattttttgtatttttagtagagacagggtttcaccatgttagccaggatggtctcgatctcctgacctcgtgatctgcccgcgtcggcctcccaaagtgctgggattacaggtgtgagccactgtgcccggcccctatctggcttttcaccatgatcagtttaaaagaagacagggcaaggagagagggcatgttagctagtttcaagtattcgaagggatttcttctaaaggaggtattgaacttattttgcctgattccagaggatggggaaggaaggaaacatcacatgttcagccaaattagccaagtaaacctgctctcagttgcagccagacctccctgcccttagattctaggaaaatagtaaagaagacgaagaacaagacctcagtgtatccttttactacaagtgactgtaaatcaactataaaattagccatgtttgtaaattaaagttataattttggcccaataatttataacatatctgtttgttgtttgtaggagtggttctaattaaagcccagatttcagagctggcatttcctcttacagcagctcagaagatatctctaaatgctcacagttctctgaagagtattttttcttctcttcccaacatcatatatactggctgtgcaaaatgtggattggaactagaaacagatgagaacaggatctacaaacaatgttttagctgcttgccatttactatgaagaaaatatattataggtaaggcaactaagcaagccaatttgatggaaaataattattatagatctggaaaaactagtctgtaaactcttactttctaaaaagaattaactagagctagtcgaagagaataaaattttccctgagtgatagatagctatttatggtagcaaaaattacccaggaatcgttataggaatttcttaaagataggaatttcttaaagcagtaattgggagattttattgtcttcaaacagctgtaccaaagaaacattttccttggtttactttttaaccaaaatctaaatgctcataaataactcattttcccaccttaacatataattagaatttaaaggctaaaagtatcatatgatgtcacctctgagttgttgtggaagctagtaagacatttaagctgttttcccacctttaccttagaaattaaagccagcaaataaatgttgtatggtaaaactgctaatcagctcagtgaaaaacacattgttttttgaataataggtagtcaaaagctcagacatttttctctttaccttataaattacatgtgtttacaaaatagcactcagtgttttatgctccttatgattatttctaaatattgcggtatctaaaaactaaattcagatatattccacatgttatcatggcatacttcaagaaaagttatagaagcttaatttgtaaaccttatttctctttacagatattatgtttgttataaataagtgaatgaattttgctattactgtgaaagttgcttttgtggaaaagaagattgaattaagatgtatggtaggctgggtgtggtggctcatgcctgtaatcccagcactttgggaggccgtggtggggggatcgcttgagcccaggggttcaagaccagcctgggaaacatagggaaaccccatctctaccaaaaaaaaaaaaaaaagctgggcatggtgacataggcctgtagtcccagctacttgggaggctgaggcaggaggattgtttgagcccaggagatcaattgttacagtgagctatgtttgcaccactgcactctagcttgtgcaacagagtgagaccctgtctcaaaatcaaaacaaaaaatgcatggtatgtaacaaacaacattgatttattaatagttaaggcccctcaaaagtatgtataggtgacttatttatatcattccaaatgtttctattcaatataagcatttattggacaaaaatactgctcaatactattccttatggggaggagggcctttgaatctttagtttacaaaatgactgttcaagagaaggacttcacagatcagtatcacctgattatggcataactagtatgaggtatttaagatctcttcctaaactataccacattaaagatgtagtgctagtttgttgtcttactagaatgttgaatggtcatgttaaggcaagaattattattttttatttatttaaaagccttttttttttattttttgagacagagtttcgctcttgttgcccaggctggagtgcactggtgcgatctcagctcatcgcaacctctgcctcccaggttcaagtgattcttctgtctcagcctcccaagtagctgggattacaggcatgtgccaccacgcctggctaattttgtatttttatagagacagggtttctccatgttggtcaggctggtctcgaactcctgacctcaggtgatccacccgtctcagcctcccaaagtgctggaattacaggtgtgagccaccaagcccagcctaaaagcctttaaattattagagtccagattatgtggtttccttggaaagaaaatattgaaattaacaaactcccttcaagttatcaagtatgtgactccaaaatcatctatataaatcaatcagcaaactgaataagagaaaactctcattgattatttttctaagactcagtcaaatatttattaggaatccacgtatgttcacatatcacatgtgtactgtggatgttatactagttgatctaagtagacttattgtgcccaagaagcttggtagtccatttaagaaacacttaatgaacatttgtgtggcacaacagtcccaaactatgagtgggttgatcatattttacattggttgtaacttggagctgattttccaatggaagcaacattagatattgcaatggagtctcatacgaggccacagacatttattaaattaacatgtagatagcatagttcctgctcttcaagctatcataaaactcaaataccatttttaacaatgtttctacagaatattcagatttacatttttggaatacaagaaatacatttatttttctgtactggaagcaaaaaaccccagcaggtcaaaccacaattaaggctcctatttaggcagcactaggaaatgtttgggtctctcaagaggttgtaatcaaggtgtaggctggggctgcagtcatctgaaggcttgactggggctggaggattcatttccaaagtggctcattcatatggctgacaagttgagttcctcttcacttgggtgtctccacgggctgcctgaatgttctcacaaagtggcagctcatttcctcagagcaggaaaggcaagaaagagagttccaggtggaagccagcctttttgtgacctagactcagaagtcatgtggcatcacttctatcaaattctgttcatcagaagtgagtttagctgtgcgttggagagtggattagaatgaagctagtgcagagaagcggtaagaggctgttgccttattttggaggggagatgatggtggcttgactagagaggaagcggtaggaataaaaagaagtggacagatttgagaatggtcggaaaatagtttgcaagatgtagtgattggtaggtaaagagagagcacaggtacattgcaaatcattgacagttgggtgaacaataagattatttattaaaacaagtaaccttgggagaaatcttgatcatattgagcttgagttcctgagaggtaacaagttggaaagtggttagatgtaaagaaatgcaatttgcaagagaagtctgggctaggcttataaggttatctgtggtgattgaacttttccttggtttctgcaccctgttttgtttttccttcttaatcttcagtgattacctctcataatggattattcttactagcctataaagacagtcccatatttctcttattaaaaaacaaacaaaatcatccattaacattacatctccctcttatcccttcgtttttctattctgttttatacccagccaaactttgttaaagagttgtaaatatactctctctcccctattatgtcttcagtttcacttcagttattccattctactcctaccatgctgcagaagctgcttttgtcaaagttacacttttgatgttgcctgaggcatggatacttctttcctcgctctaactgctctcagttatattcagcatgtcagtccacttcctccttcttgaaacagcctcctccttgctttctaacctgtctctcaggcccttctttctcagccttttctaccccctctttaaatgctggggttaatcttgagctctcgtctgtgtccttcctcttattctttctgtacattctgcctggatgatcacagctgttttcgtatttgtacttaacatcttcaccctgattttctcctccaggctccagtagtcaggtatcaaattctttgcttgatgtccatctcacatttaaacatacccacaatagactcttgtttttcctaaaaccacactcaaatctagttctcttcgtttttatactttctggaaaatggcacaccatctacccaattatttaggctggaaacctgggcacaatcgttgcatcattttctcttccctacctcccctatctaatctattagcaagtcctaggaattttcattcagaactatatcacaaattcatccacttttttccatctccactgctaacatcttagtccagtgtatctcagcaggggcattgttgacatttttctcaggacagtttctcattatgtaccatatcccacatgctgcggggcatgtggcatccctgtttaccttcccctagctgaacctcaattactgtgaaaccaaaatggaaagtcagtgcctgctggtctggaatcactcaggcctcatctgagtccctactacctattgcgcaaaccagcacaccagcagtctcttggtggggctcctcctggccttgcctcctcccctttattctccacccgttggcagtgtgattaccctttgcttcacccatcagtcatctccttgtgcttgtttcctctgcagtctcatctgctgccactcccctgtcgtccagcactctagccacgtggccttctttcagttcttcagacattttgatttttctccttaggatgttctcgaatgtcttccctctgtctgactccacaaggctggtttcttcatgtcttagattaaatgctgctctatcagagaggcctttcctaaccacccttctttattttctgttatagtagcctgggtgtgcttactgtaatttgtatttgcatactgtcttttctaaaaaacatttttactgaagttaaaattcatataccatcaaattaatcttctgaaatgtacaattcaatggctgtagtatattccaagggctgtgtagctatcaccacaaccagttaggacattttcattacccagccctttacaaagcctcatactcattagcagtcactctccattccccatgcccctcaacccatggcaactacgaatctgctttctgtctctatagatttgtctgttctagatattttatataaatattatataatatgtgatcttttgtgactggcttcacttagcatgatgttttcaaggtccatccatgttgtagcatgtatcactacttcattcctttttattgcaaaataatattttattgtatgcacataccacattttatttatccattcatcagttgatggacaattgggttgtttctactctttggctattatgaatgatgctgctgtgaacatttgtgtacaagtttttgtgtggatatgtgtgttcatttctcttgggtatatatctaggagtggtggaattgctgggtcatatggtaactgtctgtttaaccttttgaggaactaccaggctgttttccaaaattgctgcacaattttacattctcatcagcaatatgagggttgtaatttccccatattcttgccagtacttcttattccgtttttctttttgttgcatgtgctttcgggtcatatctaagaaaggtgtcatttctaagccaaggttatggagatttgctcccgtattttcttctaagagtttagtagttttacctcctacatttaggtttattatctactttgagttaagttttgtatatgggataaggaaggggtataattttattttttggcatgtggatatctagttgtcccagcatgaatttttgaaaagactgttccatccctgtttagtcatcttggcaccactgttgaaaagcttattttctttcttcttctttttgtagagatgaggtctcgttgtgttgcccaggctggtctcaaactcctggcctcaagcagtcctcctcaccttggcatcccaaagcgctgggattacaggcatgagccaccgcgcatgcccaatttcttcctatccctctacagttttacgttccttgagtgacggaaccagatttgtctttttcactagtgggtacccagcacttaccacagtccatgatagatactcagtttgtatttgttgaaataaataatggagggagagagaggctgaggaaagagtgtagagtgaaaagaggaaggaacatagagtcatcgtgtgaataaagggggaagtgggtttttagggggaaaatcagtagttatgttttagctctgttacattaaattcccccgctaatgagcctgtttctgaattctgttctcaatttattttttaaaaatcaatgtagttataaaataggtaccacatgccatggttaaaatgcacactacataggaggttataaaacaaagagtgaaagtctccttcaccatccaaccctctcccaccagtgctgcttccatgctggtgagaaggttttttgtatgtccttccagtgatttattatgttcatcccagcacatgtgtatccctttctttagaagcatgtggacagaagaatattgttcatattgttgttccctagagtctatcctggtgctccttccctaatagcacttgcaaatgttcttcattctttttatcagctacatagcattaagatgtaggatgcactgaaaattgttaatccagttttattgatatgcaaaacagtttatttctgataggaaagaattcagttgaaaaaagtaacttgaaattgtgattgtgaaatatgtgattattatttttattttcatttctaaaaataatttataaaacagtttaatatatttttatattagtatctgaaatttaaaaatggatatagaataaataaaatgtagtaatttatcatttgaagctcttggggaaaaaaaaacctttttttccttctaggatgtcacagaacatcctagagttgttttaagcattaaaattaatcctgcataaaaaccaagtgctttttggaattatttttcatttaagcatttcttttatttgaaaatctttttgaaggtcgtgtgttgtttactcttctgtaggccagcgttaatgactgccgttgatggaagacataatgtttacatccatgtagaatcaaagctgatagagaagattcttctcaacatttctgcagactgcctcaacagagtgataggtaatatatcagtgtgccatcaagaagttgttttattcaggagtataaatggtatatcagaacagaaagagcactgtactttaaattaagagcttttctgtccatatgaaaacagaaggataatttagcttaagtgaaatataagcctatgtaagttagaaggttgacttgctttacacctgttagtacatgaacagcgggaggcacctaatttcttcttaacctacatttcctgttggtaagcaaaaactattttacttaactctagttttataagaatgaagtcaatgagtgtatgacataatatatatgaagatagtccagtgtcagtggaatggatttgcaagatcttcaaccatgatgtcttagttgtcagtggctaagaataaagcaaagataatatatttgtcaggtattcaaactccattcctgttctcattagcctcagatcctctaagctgatgagctaatctggttctgtgattgctttatctttcaatagtagattgttttttgtgtttttttttagttgggggtgtctagtaattttgagttgaatgctgaacgttgcatatattaagtagaacagtacaaactgaggtaaatagtagttgtacctggaaacaggcatgcctcttctggtcctttactggaggtgaggggtgagcaggatggtcagccttgtcataagttgagttggattcaggttttgttgtttctctggttaccttcaggtcaccactggtttcaaattatcttgtgcttatggtgggaagtggttccccagtattcctgctccaccatcagcatagccctccactctgcacctgggcctcagagaaagtttctttccatattcttgcacctccccaagttgcacaagcttttgttggttgttatttggtgcatcctaacctggtgggtgggagcagggttgttcctctttgattctggtccagccccagtcttatacggatgttgcacatggcgctttcttggtagccctgtcccttatgtggcatggcagctgagctctgtcttgtgcctttagtgggtcttgtgtggtcctggccctgccccagcagtaggggaccactaatggtcttgacccagggtggtttttcagtcctcccccaggatggaggtttttttttttcttttttctttcccccatctgtactggttcctcacctgtaccctggggcaacaggatttggtgtccctcctccagcaattgaaggcttttgttccttaaaggggaggccagatggtgctttgtgttttgtagttggaagctttctctgatgtcttgccctgcccccagtcttatgagcacctggtggaggtgagacgtactatgtggaagagcctatgaggatgcagatgttccttatgttgctgacactggcagttcattggctttttgcaattaatttattaataaaaattaatcacattcttctttcctgcctgtatggaggacctgtcttcttcccaaggcctgccccaagggaacctgtgctcctgttccatctccctggaggcacctgtctccttatgtttcagtctttttggctgttttacaaccttggttctcatgtgtattcaagaaaatgatgattttatatttattcagttttttccagtaactgttagggtaggagccactttttccagctttctacatcttaattagaagcctctctccgttttttcccccattttctttatttcatttttattcttttggctattttcattccttttcttaatgttacttatatattttcagtgttatctcttctttttttttttgagatggagttttgctcttgttgcctagactggagtgctgtggcgcgatctcagttcaccataacctctgcctcctggattcaagcaagtctcctgcctcagtttcccaagtagctgggattacaggcatgtgccaccatgcccggctaattttgtatttttagtagatatggggtttctctatgttagtcaggctggtcttgaactcccaacctcaggtgatctgcctgcctcggtctcccaaagtgctgggattacaggcgtgagctgccgtgtccggcctatctcttcttttttgcataatgtaaattagtctttatctcttagagaagcataattctcatatcacatatacttcagtgttttgtccattcttgagacaattaaagttgtacttcttggcattaattagattgtgatcataagtcaaaatgtcattggtcataaagtggtcatcagaccatgcagactattactaatattggttatgttttagtttattgcagtgaaaatacaaaatttaaaagttattgtagagaattatcataccccccaaaatatgtcattggtcctccaggactctgtagtccccatccaagaaagactgtgataattgtcaaggggttagtacagtctgagcatggtcgatggtgctctgtcattctggtattgaacaacctcccaaatgtcttgattacatgtcctaaaaaagtgaggggaagagtgtaggacaaatgcaaaataaaataacacatttagctatacttttagtattttttattattgagattcaatatttaagtgaccgattcaagattcttttatataaaaaatgaatatatgcataagtaactgtgataagaactgtggatggataagagcactcgtctgatgtactgcagcataaccagaactgctgttggtctgaacggtgtgttatctgggcctgtttcttgtgtcagggggatcacatgctgtcactctggagtgcctcaatagcttgtaactagaaagagaaggtatagaaagagtagtttacttacctgtttatttatttagaggcagagtcttgctctgttgcccaggctggagtgcagtggcacaatctcagctcattgcaacctctacctcctgggttcaagcaaatctcctgcctcagcttcccgagtagctgggattacaggcatgtgccaccactcccggctaatttttgtatttttagtagagacagggttttactgtgttggccaggcatgtctcgaactcctgacctcaagtaatccagccacctccgtctcccagagtgctgggattacaggtgtgagccaccgctactggccgggaggagaaatttaaaatgggtttgagacttgaggaaccaaaagaaacaatgaaaccattcaatgtgtgtgctcctgtcaagctagcagcgatcttgagagctctgtgttttcgtcttctgcagttccttcctcagagatcacctatgggatggttgtggcagacctgttccactccttgttggcagtcagcgcagaaccttgtgtattgaagattcagagcctttttgtgttagatgaaaacagctatccattacaacaagatttctccctcctggatttttatcctgacatggtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttcctttcttctggagaaatgatctaccagtcaaggcaatatgtagcagatccctgggaattaaaggtttgcccatttgttcactgtatttagtccctgctacattccaggcatcgtactaagtatggggaaccacagagaagacactccttcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaagtgaaggaaatgagatcatgtttcaatttattaaagcagggaagagcgttctgtggttagttcgtgtctaggatttgagtgccttactgaatgtatttaccagcaaacatgtagcaatctgttctctcattgtgattgtggaagaagctcatgtaaaatgatagtcattaatgaggaagtatggcgtggtacttattctgtaagttcagagtatgctgagtgttaatagattgtcatattgcctgaaaataaattcatgatgacatgaacaagcttcttttaccctgtgtatgtttttaaaaattcctttggttcagaggtggttgttgttttttaacttggcttccctaagaacgaaccacaagagttttgtgattctttcaaaaataatatgccaaaatgcctttgtgggagcacacacacacaaatgcatgtttctgtggagaaggatccatagctttcaacaaatcctcagagggttctgtgaccaagaaaggtaagaacaaggctttaactgatgagtttctttgtggggtagataagggaattagagcaaatgattgccaaagttttgtctagcaactaataaggtgggtacagaaagaattgactccattttgtatctagagagactggaattcaaacaaaatcattggctcccttcaatgattcgttgaatgggtgatgaaacttgagcctgtagttgacgccttctaatctgtgctctctcaactataaccacactaggcagagatttggaattctgatataaaatctgcccagtcaatataggccaaccaagagagctgttcgcttaagtgtgcccttccccacttcgtcctcaagtggagacctaatccctacatcaaccagaacataatccccaggaagagatggctcttcacatcctattgggaagaaatctttaaaccatttcaggtgagtcaacagatcacaccaacatctcttcacagttgttggtatgtatttcattaattaacacatatttccaggagcccttatttaggttgggaactgtttcctccagtcctgaggaatctgagctatctacagaagttatgagctatttaagtgggatcaggatcagcccattgctcctgctatggtctgaatgtgtcctcccaaaattcttacgttgaaacctcatctctgatggcattcagaagtggggcatctgggaggtgattagatcatgagggctctgcccttgtgaatgggatcagtgcccttacgaaagtggcccgagggagcttctttgtccccttctgccacaggatacagccagaaggtgtcatctttgaagcagagagcaagccctcactagattctcaattttctggcaccttgatcatcccagccttcaaactgtaaaaaataagtttctgttacttataaattgcccagtctgttattttgttatagcacccagaatggactaagacaccttctgtgtgtattctttacctgagttgacaagtaagtgtctttattctgttatgttttcataaaactcagtggggtagccagagtgtcatccagcagtcccatatctggcagtcttatggtgggcatttcagggagacctcattcttcatcttctgttagttcagcttgcagggacagctctcctatttttagagaatcatttttatttgttagtcacttagtttccccagaggtatcctttttctaacagcgttagaggcattcacctttctccccactagtaagatctgtgctgtttcattttacatcttttttttttttttggttgggggaaagggggctgatcatcaaatgagttgacaacattgggtgcatgatccaccctgcagacgttcgctgaatgtctaccatgtgctaggcactggaaatgcaaagacacaaatgtctgccttctgtaagttcacaggcaagctggtgaagaaatatttaaacaaaattatatcagcgccaggattaaatctgtgtggaatacagagccaaggcaaaagaggtaacagtaggatgggtttgttagtcatgactcttggttgcaagtgataaaaacccaactcagagtagcttgagcaaaaaagggggacttgattgactcacataaatgagggtagtaccagcttaaggcacagttgaatccattggcctaaattacctggttaccccaactccctaatctttctttctttctttctttctttctttctttctttctttctttctttctttctttctttctttctttctttctttctctttctttctctctttctttctttctttctttctttctttctttctttctttctttctttctttctttctttcttttttttctttctctctccctctccctctctctctctctctcatcagaagaggtcttttacgctgttattgcaaaagcatagatgtttctacagagttttgataggataacattttcacagtgattatgaatttacatcgtccctagaattctaaactactgggatctgaggccgtaagttgtttaagagtattctgacattaccttagattcagcaaaacttgaatagttgatcatgcctttcttagaagaaaatatctgtaatttctcagaacaatatagaatgagacagaaaaactaaccatccctatgtgccttattttaagtgatatatttgtatcctgatgggtttctaggtgttggaacacaggtcatgaatcatagaacaattagaataaagtgttcgtctttatcagtagcttaattctggcccttgatttaatgtcaacaggggagaaatgtgtgagaggggatgaggtttgccaattaattgtcattatgtctttggaggtcttgaacctgatttgttattaagaagtgaattctacccacttaaggcatacatttgctaaaggtgacctctctgcttccacgttgttaagaaatcgtgatttttttcaaaaccatcatcagctttacagtttttgaggaaagatctagaagcctgttaaaatggacttaccaggcagggttcagcccaggaaacacaagccactctgggtattctaaacagagagagattaatgtggaattcaggtgtttgcaaaggtattggaaggctggaggagcaggcatcagtctgagctccaggaggctgccacgtgaacggtggattcatgaaaacatcatcattggctgcaatcttagactgaggatgcagctgctggcatcccagcaactgactctcaagcacatggaagctgggagttatttgctgctgcccaaaactcagtccccacagctacacttgccaggaacagtagcttcaggaagatagcctggatttcactcatcttccatattgcacatgtgtgtgtgtttcattgatggaacatgattcacgctgagagctttagctgcaagaaagtttgggaaatatgtcttctctgaggcttttggtctttgcagttcaggagcagttaggaggtgggactggttggttgcagagtgagctgatttactgcacttagtctagcttattaaaggatcagcttataaacaccccaggtaatatcacaatacataagtgctacctaattactgtgtgggtctgttaccaagaatgtctaagtcaagaaattgaagattgtttccttcagattctgcatcctaatgtagaatctttcctattagagtataagtaaattattttggtgtgttatttaagaatatttgtgaataggcttaattaaacaccatgttaagaaattataaacttaaggccaggcacagtggctcacgcctataatcccagcactctgggaggctgaggcgggcagatcacttgaggtcaggagtttgagaccagcctggccaacatggtgaaacctcatctctactaaaaatacaaaagttagccaggcgtggtggtgcacacctgtaatcccagctacttgggaggctgaggcaggagaattgcttgaacctgggaggtggagcttgcagtgagctgagatcacgccagttcaactctagcctgggtgacagagtgagactctgtttaaaaaaaaaaaaaaaattataaacttaaaaaaaaaacgttttcctttaaacaaaaacgcatgttccttgttttttgttttgttttgttttgccttttttgagagacggtcttgctctgtcacccaggctggagtacagtggcacaattatggctcactgtagcctctacctcctgggcgcaagcaatccttccacctcagcctccctggtagctgggactataagggcagaccacaacaactgattttttattttttgtagagacagggtctccctacattgcccaggctggtcttgagctcctgggctcaaccgaccctcttgccttggcctcccaaagtgctaggactataggcgtgagccactgcaccaggccgtttctttttttttttaactttggaaaatatggatgaatgaaagtgagaaaagtaacccttctgttattctaccaaccaaagctaattgctgccaacattttaatagatattccttcagttgttttatgcatgtatgattttgtacatgtgtctgctttaaaatatatagtctttcaatgttgcccaggctggactcaaactcctgggctcaagtgatccatcacctcagcctcctgcatgtatctacatcttattttattttatttttagagacattctgttaaccaggttggagtgcagtggtgtgatcatggctcactgcagcctcagcctccctgggctcaagtgatcctcctgcctcagcctcctatgagtagctgggactacaggcatatgcctccatacctggacactttttgtattttttgtagagacatgtttttgccatgttgcccaggctggtctaaactcctggcctcaagtgatcccctttgcctcagcctcccaaagtgctgggattacaggtgtagactaccacgtctggccaacattctcattgatagtctttgcacacatctttcattccttctgggaatttattctaagaaaatagaattttggggtcaaagtacttgtatgtatgtatctgtaccaggaaaaaagcagaaattccagtatcaacagataacgagagccacgcagggtggtacatgcctgtagtcccagctactcaggaggctgaggcaggaggattgtgtggcatgagcccaggagttagaggctacagtgagctatgattgcaccactgtactccagcctgggcaatagagcaagaccctgtctctgaaaaaacaaaacaaaacagataaccattgttactattttgttgaacattttccagataccctgatagaagacagatctgtgcatgcacatacacaattttacataaatgggaccattccatataggccagtatctagtgtgtactttttttactccacaatttgccatatacgtctttccaaatcaatcaacatagattaaatcatatcaactacacaggattccatcatttgtgtgtgctcttgaatcctacttttaaaatgttctcagaaaggttatcctgaaatatattcctatcagaagttttccacactctctctaaactgaatggcataagtgaaagactagttgttaggtttaaaaaaggttatctgttttaattggaattttttttgaggttttctttttcttttttctttttctttttttttgagacacagtttcactctgtcaccctggctggagtgcagtggtgcgatcttggctcactgcaacatctgcctcctgggttcaagcgattctcctgcctcagcctcctgagtagctgggattacaggtgtgcaccaccatgcccagctagtttttgtatttttagtagagacaggattttgccatgttggccaggctagtcttgaacttctggcctcaagtgatctgcctgcctcagcctcccaaagtactgagactacaggtgtgaaccactgcgcccagccttaattgaattattttattgctaaagtgattgtacatttgcttcatatgcttatcagtcatttgcagtttgctttttcatattttaccttagaccatttttatgtgggagaagccttttattaaattagtatgttctccttataaagttagtaatttttaacatgtgttgcagacatttttcccaagcttgttatatatgtttgacatgcagaaatcataaatatttacgtggatcaacccatcaatctttttctttattgtttctagattttatggcatgcctagatagcttcttttctactataagattatacacattttcttcaaaaaattttctgaaacatttatgattgttatatttgtatttaaatctttaattatctaaaatttagtgcatggtatgaatggatctaactgattcattttcctaaaatggtcagctggttgtcccaacactattgatttctttctttcccatcagtgacatagatgtgatctttattataatatgaaattattattcctgctagcattacctgtggactttctagtctgtttcattgttctatatttattgctgagccagaaccatacagttagaattattataactttacatctgataggaaaagtacccccatatttttcttcattaaaattgtttttctcagacatctttgcccatctgttcttttttattccccattaagagtatatgttgcagtgttttttagtatattcagagtgtgtgaccatcagcacactcaattttggaacatttcatcacccccaaaagaatcatccatagttacattaactataccaccccacagctcttccttaagaggagctaacagtcgctcctccatacccaccccctttcccccaaccctaggtaaccactcttctacttagtggctgtatagatttcactattctgacatttcacatgaatggaatcatacaatatgtggtcctttgtaactgatttctttcacttggtatagtgttttcaaggttcacacatgtagcatgtatcactacttcattgtttttattgccaaataatattccattgtatggatataccgcattttatgtatctattcatcagttgatggccaactgagtttttcccactttttggttatttttaattgtactatcatgaacatttgtgtgcaagtctttgtgtggatgtatattttcatttctcttgggtatgtacccaggagtggaattgctgggttgtatggtttaaccatttgaggaactgccaaacttttctaatgcaggtgcactattttacattcccatgagaatgcattggagttctgatttctccacatcctcaccagcactttttattattatctgactttttgattatagccatcctagtgggcatgccatctgttcttgagataagtttagaatcatttttatcccattgatatttttaatgagattgctttgaatttatggatcatttggacatgttttcagtggttaaggcttactatttaagaagagcatgctttttcaattaataaagtattctttaatgttccttagctttagctttatttagcagtccacatttaaagggtattaactatggaaatttttttttttttttgatacagggtctcactctgttgcccaggctggagtgcagtggtatgatctcagctcactgcaacctctgcctctcaggctcaagctatcctcccacctcagcctccttggtaactggggctacaggcatgtgccaccacacctggataatttttgtattttttgtagagatggagttttgccatgttgcccaggctggtctggaactcctgggctcaagcaatccacctgcctcagcctcctaaagagcttggattacaggtatgagccatcagccagtttttttgtttttttaaatcattgatttcaactatgctctgttgaatcccttttccatcccctcatgtctcacatgcctcacataacttcccaggcattgtgttttagaaagtctggtattgtttaaattccaacctcattttgctcttctccagagcatgtccagctagtcactaaagggacttggaatggggaggagataggtgcacccttcctttcctttgactccagctgttggagctggagggagggcgtgaactggcaccgaggtgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgctatggtaaaaacagcaccatatattgaatgctgattcagagcatatacagccttctggagaatttgtcccaattctgcaagacattgccacctagctggtgctgcagcagagtttttaacaggctattccaccattctatcaatccaattgcttcagagtcatgcggaacatggtaagaccattggatcataagcgtgggcccattgctgacatctattgctaggaagtgacttatttgatcacacgcaatggtgtgtgatacactgtgatagtgtataaggcattcgtaagtctcttatggtagtttgggaagaggcactgcatgcagggaaggcaatccgtattcaaagtaagtgtctattcctataagaacaaaatgctgctacttccatgatgaaattcataccatgtaatcagcctgcccccaggcagccagccgattactccagggaatgtcaccatatcaggggctcaatattgtcctctgctactggtagactgagcaatcaagtcaggcttggtgagtggaagttcatattgttcaatatattttaacacagttaggcacaccagctgctgcagctgggacaggcagctccaggtgccagcatgagtgctagctcactataaggctttggctggaccagacacaccacaagcagcttccatggctgttacaagggaacacagttgtacctggaagcttgcagactccaggaaccacagggtcccatagcgggagtcacagctctggcctggggagctcccaggtctgggttcccatagagccacagctctttttttcttctctcttcttgtcatccacaacatggtgagcaaggggcatgtttcaaccttgtttgtgttacagcatttttagtcctgtcatttggcaagtcccaagttcttgtgctacctccaggaagaatgaggtatatagacaagtggagagtgagcaaagaggagctatattgagtgacagaataactcagaggatgtcctggagtgggcacctccattctgcagctgggcatcccaatatctgcatctctcagaagagatgaggccctggagtgggtagctgctctctgtagctggttgtcccaatgtctgctcagttctggctgagcctggggcttttataggtctcagaaaggaagaaatgcacactgatcagtccatgagaggccatggatggccccagaaaaggcatcacaagtttacactctggttcacgggactggcagcccagaccccagccttcacacccatcctggcctgaaggaaaggcctcaccaaggacccacccccttctgtgcaggagcctgtctgcctcctgctgccattcatggcacccaggctatttgtgccaaaggatgcctgcaggccagtgccaagctgccctcagcatctcctcagcttccctcccatgcttgtcagtgcccaaagcctgggcaggggccagagacagtatggtactggtgtatcagcactgcctcaagcatgtgcacacccaccaggctgcaacagcacctgagcctacccacaaccttgctccaagatcagagcagatgtcaagagtggggaggagccaggcaatgggagcagaagatacctccaagtctgcaagggcctggggttttttcctgtgcccccaagagtgtagagatgcctgactctgcagccgtggcttgggcatctgtagttgcatcttgaaggacaggtgtcctgtgtgctccatggaatgggaggcccagatctgcagccactacttgggctgctgcaactgttcccaggaagctctaactccaccaactcagaaggggcatgtttcccacttgtatccagctctttaccatgtttcaccgctgtagctgatgtgacggcagtggctgctccagatggggtgccactgccatctttgtagcagtagataattatactacagtgtatttttaccaggtaaagtaaggtttttatggttcactgaggacaatcaatgccttcataaactagaacctgaagactgatcttctgagaacatcaaagaaagactgtcattggcatgcacactacagtaaaacttcaggaccttgaaccttgggttcataatctcacaactgagaaggctccctttacactcttggaactgtacacccattagaagccttaaagaaaagctaaccaggggggtttctccccagaagatggcatccttgactgtgaacaggttttcccaagatcatggatcaagaattctctactatcatgagactcttatctttgattatttgtcccttgcttatgcttctatgaataatagaagtgaaagggttctcttgtgtgcatttatggggtatacttttatttgtgaaggattttgcagccagccttatacatggataaccttataccttaatagacaaaaatgaaggcccaatgtagatgagaaactttaatggtacgtacattgcctcataatcagtcagaaacagaacattgatttactcctcttaacccacatcatgggttaaggagaacatcgctgggaggctttcactcttctaaaagggcatcatttgttaggtcctttttccatagtttggaataaaagcggcaaagattaaaaatgtattcctcatgataggctctgaagcagattctactgtaaaggctatggttacacaataaactttaaattctcttgtgaaagttatgctaaataatagaattgatctggataagttactagctaaacagaagtatctgtacagctgctggcacttatggcctatggggaaaacatcacatattatagatttagttgtaggggattaatgaagagactcttttttttttttttttttttttgagacggagtctcgctctgtcgcccaggctggagtgcagtggcgggatctagcctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgagactctttagttaagtgagtagactcttcatgtagctcatcctttgatctatttaattttgggtggtttggtttatggggaccccgggtaaggagcacactccaaactcttggtattatcctactgatagtcataataatagtctttctggtgtgctatattctctttaaaagtgttaaatgtttgcatgcagacatctctagcatgtcaaatggtctctctttaactggaatgacaagagctgaaagaaatgtgcagccatgaggacaccgtaacttatgaatgacatgctgagaccagaaatccacaatgatggtaactgagagtggtgctaaggccctaagtttggtcacactctcacctaagtgagaacatgacctaaaaaaaaggggattcttttaaatgaaattatgggaggccattgttttggactgagctcatgcactaggccccaacagaccaaaccagacaaaactggggttgcttgtgctgaatgtaacataatcaaactacgtttgatcatggaaaacatagcaaacagattctagaacagaccaggttttgtttttcttctgtaaacagaatgttccaacatatggacataccctctactcggtccttgttcccatctttgccaaactcactgttctgctctttcccagtaagtttcaagagccatggtaatagtaacatcaataactaaagttttggtcaatatctcaagattgagaaaatgacccaaagagggaaattgttaaatcaagtttagcctaaagctgcctccttacatattaaagttcaacctaaaggtttttctatacatcgtgaactataacaagtgaagttgtaaaccaactgtagcccacatctgtaccaatcactgagttttggccaaatgtagctaacagttccaaccatgttcaaataaggcaaagacccagctgcaaccaatccagttgcttctgtacctcactttccttttgctgtccataaatcttcttccaccacgtggctgcgctacagtctctctaaatgtgctgtaattctgggtgctgcctgattctcccatcattcattgctcatactactttacatttaatttggttgaaatttttctcttaacgacaatcatagaatcagtgtaacaatctgtcttgaaaagtagtaaagtgtgttacttctataggagaaaacaagacatctgtaatgataagccagaatggtcactgcaaacagcaagatgtatatttaactcagcctattctttgtgtaaaatatatatatatataaaatttaaagtagtttgagcaatgaacgatgggagaatcaggcagctcccagaattacagcagatttagagagactgtagcgcagccacgtggtggaagaagatttatggacagcaaaaggaaagtgaggtacagaaacaactggattggttgcagctgggcctttgccttatttgaacattgttggaactgttagctacatttatatatatataatctatttatatattattaaatatatttacatttttatatattatatattattaaatatatttatttttatatatattatatattaaatatatttatatttagatatattatatattaaatatatttatatttagatatattatatattaaatatatttatatttagatatattatatattaaatatatttatatttagatatattatatattaaatatatttatatttatatatattatatattattaaatatatttatatttagatatattatatattattaaatatatttatatttagatatattatacattatatatttacatatatatttatatctttttatatataattttaaatttataaatatttatatataatatatataatatatttataactttaaatttataaatatttatttatatataatatataatatatttataaatgttaaatttataaatattaaatttatttatatttatttatatataatatatatttatttatatattatgtatatttatatatatggaaaacacattttaactagcttcttcactctctcttttatcacttttttacttagatttagaacaatgtgaatagttcatgagctcaaatgttctcccaagttcagttaataacaccagcttgaggttgctgtacacacttaaggaaatgtgctaatatttaataaaactaatattaataattacctcatagaccctccactctttctctttttcataataagcaaatctcctctttttataaggctcacattggagggtttatgccatatttattttaatacaccgactttgtgaagatatcctgagttctagaattttttacatcaacatttttcagattgatttgtcatgaatgttattccctgtccatctttttttcatctgtaactgtttattaggacttgttatgtaccagacattttgctagcaactttataagcagtatcccatgtaatcctcaaaatactctatgaggaatttttgttatttattctcctttacaggcaagggaatctaaatctcagggaagttcattacctgttccagtgttacagaggagaaaggtgatggaactgggatgttagttgcatccaggcaatcctacatcagctctcacttttaatctcttcccaactttgtctctctctatttcttttcagctgttaatgatttcatatgtatgattgattttgcctgactgagccaaactatattagcatgttattagattagaataacttaatctctttacttggagaaaaaaaaaacaaatcaattaaacaactgcactgatgagacagaggaactgttttaggcataatgtagtctagaagttttttgagtgtgatcaacagaccaacagcatccacatcatacacaaatgtattagaaatgcaaattcctgggtaccattccagcatgaatgaatcagaaactaaggaaacagcaatctgtcttttaacacatcttttaagtgaattttaaattctaaaatatattaaccactgccataacaaaggggtcagcaaattaatgaacatgagtcaagcttaggcacctcctatttgtttgctttttaaaatttcaatatgatatacatacatcatttaaaaatttttaagtgtataattctatggtagtaattacatgcaaaatgtataaacatcagaactatctatttctaaaattagctcatcactccaaacaaaaactatactcataaaacagtaacaccttttaactctcccctcacatcctagtaatcactaacatattttctatctctatgacttttcccattctagatatttcatatgtttgggatcatacaatatttgtccttttgagtctggcttatttcacttagaaaatgtttttaaggttcattatgctgtagtgtgtatcaaaacatcattcttttttatggctgaataataatcctttgtatttatgtacaacatttttgttcatctattcattgcttaaagattcatctgttagggtttttctaccttttgactattgtaaaaaatgctgcaaaaaaaaacactggtgtacaagtatctgtttgagtcacgcttgaattattttgggtatatacctagaagtggaattattctatgtttagctttttgattaacctccaaattgatttccacagtaagcgcacaatttgatattcccaccaccaatgtaagtgtctttaactttatccacatcttggctaaccctttttcctccccctattctctctctctatttatgtatttatttatttttattactgtcatcataatagttgtgaagaaggccaggtgtgctggctcatacctgtaataccagtactttggaaggctgaggcaggctgatcacctgaggtcagaagttcgagaccagcctggccaacacaatgaaaccctgtctctactaaaaatctgaaaaacaacaacaacaacaacaacaacaacaacaacaacaaaattagccgggcgttgtggcataagactgtagtcccagctgctcggggggctgaggcaggacaattgcttgttgaaacaggtgtcctttcctcactttgtttttgtttactttgttgaagatcggttggctgtaagtatttggatttatttctgggttctctattctgttccattggtttatgctcctatttttataccagagcttttgcactgcaaaaggaacagtcagcagagtaaatagacaacccgaagaacgggaaaaaatattcacactctgtacatctgagaaaggactaatatccagaatctacaatgaactcaaacaaatcaacaagaaaaaacaaacaatcccatcaaaaagtggactaaggacatgaatagacaattctcaaaagaagatacacaaatggctgacaaacatatgaaaaaatgctcaacatcactaatgatcaaggatgggtacaccagaatctcataaatcaccactaaagaacttactcatgtaaccaaacaccacctgttccccaaaaaactatggaaattaaaaaaataggttctttgtcttctgttattgagttttaaagattctttatatattttggatattaaatctttatgagatatatgatttgcaaatattttttccattctgtaagctatctctcactttcttcataataatgtcctttgatgaaccgatgttttcaactttgataaagttcaacttatctagttttttgttgctgtggtatttttggtgtcatatttaaaaatccattgccaaaccccagttcatatttatccctaagagtatcatggttttggctctcatatttgagtcatcgattcattttgaataaatttttgtatatagtatgagtaaattttttacacatggtgtgagttaatttttgtatatgggatgaagcctaaccttaatttgcctttggaaattcagttgtcctaacatcatttgttgaagatttttctttgcccattgaatagacttggcaggcttgttgaaaataaatatttcatatttatattatggaaatataaatatttccataaatatatggtttatgtctggattcaattctattccatgtatctatatacctatcctatgccaattccatgctgttttaattactgtaggtttttgataagttttgaaatggtagagtttgagtcctccaactttgtctttgttttttaggatttccatgtacaattctaggaatttgagaattggtatttcagtaccaattcagtactgtttcagtaaaatgactgttggaattttactaaatattgtattgaatctttagacagctttggtagttctgctattttagcactattaatttgtcttcaaatccatcaacacagggttgctttcaatttgtttagaacttctttaatttctttcagtgatgctttgctcttttcagtgtacaagtgttcacatttttcattaaatttattcttaggtgttttgttcttttagatactatcataaatggaatttgtttcctaattttgtttttggattatttatttctagcatatagagacatgaatgaatcttgtgtgttgaccttgtaatatgcacttttgctgaattttttattagctctagtagctttctgatggattttcttcagattttttttatatatagaattatgtaatctgaaaggagaaataatttattcctttccagtttggatacctcttatttgtctttcttgctgattgctctgctagaagttgcaatgttcactagtgattaaagcagacatccttgtcttgttcctgattttaaagaaaagtgttcagtctttcaccactgaataggttgttagctgggggtatttttaaaatgtcctttattaggttaaggaaattcccttctatatgctcagtgacttttatcatgaaggtgtgttgaattttgtcaaacgctatttctgtgtcaatgaattgatctttttcttcttcttctttgctctattacatcggtaatttcagtgtgcttctttacattgattggttttcttatgttgaactacttttgcatttataagataaattcttcttggtcatagggcacaatcctgtttaggaatttggtttcctagtatttggtaaagatttttgcatttatatgtgtaaaaaatattctcctgtaattttctttacttgtgatctcttcatctgaacttacactaggggaaatgcttgtctcatagaatgaattaataagtaatatctccatttctgtttttggaaaagtttgccaagcaatttctgccagttcatctctaaatgtatcctagaagttactattaaaaccatctggtattcgcggtagctcatgcctgtaatcccagcactttgggaggccaaggcaggcggatcacgaggtcaggagatcgagaccatcctggctaacacggtgaaaccccgtctctactgaaaatacaaaaaattagccgggcgagatggcgggcgcctgtagtcccagctacttgggaggctgaggcaggagaatggcgtgaacccaggaggcggagcttgcagtgagccgagatcacgccactgcactccagcctgggtgacagagcaagactccgtctcaaaaacaaaaaaacaaaaaacaaaaccatctggtaggtatcataattttcttgattgggtgggttttttactacaacttctatttctttacctgttattggtctgttgacatatatttattatttcttcttgagtgagcttaggtaattagtgtgtttctagaaaattcaacaatttcatctaggttatctagtttatggcctaatttggtcatattattctcacaatcatttttatttctataaggtcagtagtaatagccccagttttatttctgatttcagttatttattatctcttttcttctttatcagtatagatttgtcaattttgtcgattttttcatagaatcagcttttggttttattatttctttctctataattcctgccctgtattgtatgtatttccattttaattatcattatttcctcccttctacttgtgtttaatttgctcttcttttctggttcataaaagttcgaagttatattattgatttgagatcttttgtacatttttaaatgtaggctcttacaactataaattttcatctgagcactgcttttgcttcatctcataagtttagtatgttgtgttattacatatcttcagatatttgtaatttctcttcttcgatccattgcttgaaaaggcactcatggtttaattgccatatattgtacatttttcagtttttctcctgctgttgatttaaagttccattccattgtgttctgagaagatgctgtgtataagtttaatgtttttaaaatatactgaagaattctttgttgcctaacacatgggctatcagagagaacatgtattctgctgttgttgggtggaatgtcctgtgtatgtctattaggtatagttgatttatataaacactatactttaattcccctatttccttgttgcagattttctatcaagaatttgaagtggcctattgatgtctccaactattattgcagaactacacattctttccctaaattttgccaatgtttgctttgtatattttgggggctctgttgtttagtgtgtgcatatttataactgttatatcttcttgataaattgatccttttattagtgtttaatgcccttgttccaattgtaacagtggttaaagtcaattcatgtcatattagtagagccacaccacctctcttttggttaccatttgtatggaatatatttttctgtttttcactttcaatttatttgtggcttgcatctaaattgagtctcttatagaaaatatgtagttgtatgattttaaaaatccattacactgatttttgcctctcaattggaaagtttacttcatttacttttatagaaattattgatgagaattactactgccattttgctttttgttttctataattttttgttcatttcttcccttaatactttttttgtgattagttgatttttatagtgaaatgttttaaaaagctttgtcattttcttatgtgtgcattttaaaaaaattgtctctaactgccataaggattctatttaataaatttataatcatctatgttttaattaatgcgaacataatttcaatagcatgaaacactccatatctatgtagtccccttacccatttcatgttgtttcacaaattacattcatatacattctgtgctgaataacataaatttataattatttttataaatttttttcaacacatatagaaaataaaaatggagttataaactaaaaataaaataatgctaagttttataattgcccatggacttactttttccaggaaacctttatttcttcattcatctttaagttattgtctagtgtcttttcatttcaacctgaaggaatctgtttagcatttttcactggacaggtctgcaagttataaactccttcatcttttgtttctctttaaatgtattaattttttactcatttatcacagaatgttttgctagataaagaattctcagtaagtagttgttattgtttttggtctttctttcaggactaaaacatgttattccactatcttctcacctccatcatttataatgagaaatcagctattaatcttattgaaaatcccttgtaaataataaattgattttccctagctacttgcaaaattgtctgtctttagctttcaataatttgacaactgtatgtctcagtgtggatctctttatcttacttgatgtttattcatgtttcttgaatttgtatatttatgtctttcatcaaatatggaaagttttcagccattatttcttcaaatatttgtcctgccttttctctctgtcatctttttctgggattctccttcatatgttggtccccttgatggcatttcacaagccccttaggtgccatttacttttctttattatttttttttctacttctcagacttgatagatagaatagataatttctatcaccctattgtgaatttcctgattttgccttttggctggtaaaatttgtgttgaatttctctatttaatttttttattccagtttttatactttaaagctccagaatttttggctccttttatagtttttctttattgatatttttattttgttcatttattatatttctgatttttcttatttggttgttcaggttttccttcaattatttgagcatgtttaagataatttttaaaaataatctttttgccggcaattacaacatctagacatttttagggatggtagttgttaatttattttgttctattaaataagtcttatttcctatttctttgtatgccttgtgatttttttgttaaaaaaatggacacttgaatattacaatgtgattctggaaatcaaatgttcctacttctcagggtttgctcttttgtaattattgaaggctgtagtaaactcttggtataatgacatttctctactgtttttcagcaaatatatttgttgcatatattgtgaataaagtttttgttctttggctttttttgttcagctaatgtttgacagagttttcttgaacaccaggaactaaaaaaaacaacaaccaaccaaacaacctctctctgtctttactgtttggctctgtctgagtacctctttaaacacttagccagacttgcattaaggttagggatatgtagactaaataaagaatatgtggtacatatataccatggaatattatgtagccataaaaaggaacaagattatgtcatttgcagggacatggatggagttggaagccattattctcagcaaactaatgcagaaacagaaaaccaaacactgcatggtctcacttctaagtgggagctgaaccgtgagaacacatgaacacatggggggaaacaacacacactgaggcctgttaagggtggtaggggctggcaggagtgaaaacatcaggaagaatagctaacggatgctgggcttaataactagatgatgagttgatctgtgcagcaaactaccatagcacacatttacctatgtaacaaacctgcacatctgcacatgtaccccagaacttaaaataaaggttgaaaaaataaaagtttagggatcagtatcagacaaaacaaagatccaaaacactataaaacttaaggacttcttaggtattttttgaacatgcactgtataattggcatgtatgaggcttttcaaatctctcctaactcatgggtgttttttattaccctaattttccaaggaatatctctgttcttattgtgtttccaggccttggatatttgtttatatatcttaaatgtcttttgcctcaagcttaggtttcttaggagtccaacaatatatttaagcaactcccaccacttttaccgcttggatatgctgtgcaatagacaaaacagatgaaagcaccttacatcattcctccaggtagcccccatagaggttaaaacgggccaaaataatttgcaaatgaagttgtctcttctacctctggaaacagggactattctctcacactgggaacgtgggctgctgtctgcaagactgctcttcaactggggagtggttatagaaagggaaagtaaaactgccacaatgattttttattatttttacattgacattttattgctttagtgttcactgtgttgctataaacctgtctgttttccagtgttctgacaatgttgattctgatggcttctactcatttttcaatatttctatggagggacagaagcttggagttgccaaatgcgacatcttgcttatgtcactccctcctatctgttttagtaaacttttttgtgtgcgtgtgacaatacaacaatttaaatttattgcatatactcgtggctgctgttttgctacaatgagttgagttcaaccaagattatataccctacaaaaaactaaagcacttattatctggccaattgaaaaaaaaaacattttctgacctctgctctagactggtaaagttcagatttcacaaatttcaaatagataacttcctttatagccactttgtttttatagtccgccttcacatttaatgagtctacatttattacttagtacttggtatataccaaaaattcttgatctctttcctgaaattttacatctactttagagttaaaaaaataactagaactcagagcatctcagaaatgttcagtctcagcaagctagtgaatgttttactgtgaacagattcacaggctttactgattccagagccaaaatgctaataagtttaaacatatattttggataaaattgatctgcctccataacaaaggcactggtcttacagttaacctgtaaatcagttgtggatgtaaaggcattattgccaattcaatttggttgagatgagctttagtattcaatcctattgttctgagtgtcaattagagccaagagtgagcctacaatgttatcgatgttatcgattctcctccagctgagaacaaagttctagaatggccagctcatttttctggtctttattaacctaggcagcctacacctgcatttatatttaattatcataatgagcttctttttaaaatagtatcacagagggggatcagagtgtttgttcattaaatctctaatgaaacattgtatgtagcataaatgtattattctggattatattacatcacatcaaagtacagaatttaacagaatgtatcccaaactccataatagtttggccagatacagaaacaatttccttcatccctactgagagcagactgagttgtggaattcccaaatatagctttcattgaaatggatgggacttctaagatcagtagtagcatttatatgatgttattcttcaattgtaagccattaatttgattagttatccatttgcatttttacttgttatactgatttcattgcaaactggagaaaaaataaaggaaaaacaagcaagaagatttaactttacaaatgtttcatttccactaatttctactatttaaaaaaagaaatgtaaattgaagcagcataacttaggcaaaaagcattggattcatatttggagtcctggattctactcacaactctgataataattagctgctgcttcttttttttttttttttttgagacggagtctcactctgttgccaggctggagtacagcggcacaatctctcctcactgcaactctgcctcccaggttcaagtgattctcctgcctcagcctcctgagtagctgggactacaggtgcgtgccaccatgcctggctaattttttttttttttttttttggattttagtagagatggagtttcaccatgttggccaggatggtctcgatctcctgacctcatgatttgcccgcctgggtctcccaaagtgctgggattacaggtgtgagccacagtgccttgcctaataattagcttcttaagcttgggcaagtaatgaccattgtgtttcactttaaaattaatgataaaattaatcattttatcagtgatacaattaatcattttatcagtgataaaattaatgtgtaagaaggtattgtctctgcttcagaaaaatatgtgctgtatgttattgttttcactgggaaagaattggcaaattccatattttatattaagctcctcaaattttatgttcctcattgtgggttcattctgtacttaaccttgtattataagacttgctattgtggatgctgtggatgccaaggcccttgtcccactgtggttttactaaaaatctagttgcaaaaggcagattaggaggaaaaaaagacttagaaattcatttaatgagtatacacggcagccttccaaatgcagaccctaagatacaggggaaattaacaaagtatggacagctgtgtagaaatactattggaagaaaggtatatgacctaataatgctaatagactgggtagggaaacccagcaaggcctgtcagtctagatttttcttgacatttctaagcatgtgtttttttcttcttctggttatggggcagcaacatctttggagtgggggtcttaagatgttcagtcaaacgaggtaagtcagataatttctttatggccagttttcacacagataaagtggaggaaaaatcagagtaatatatttaggttttatggctagctttaaagaaaaggggttctaggggttctgtttactatgacccactgttgtggaagagagattctagtttccatggccagccttatgggagaataaaactgagagacaagaggacaggagaaggtcagagaaaaatgtttgtttctgaggctgctgctgagcctttcatttgggggttttgttttctgatccccagaactatcctacattgtaattgcctatttacttgtctgagttccctagttagaccctgtgctccttgaaggcagtgagtagtttttaaatactattttactcaattgcaattgcttaatatctggcacacagcaggacctctacaaatatctgtgcatgaaagaatataattttcatcactcattctattctgaaatgcacacacacacatacacacactgatgaatcaatcaatggataaacagacaggtagataacagctaatagaaaataatgactgcaggttgtataacacaatcaaagtgtttgttgttgtttattttctttgaaattaactggcatgctcgatctcattgacactagcatcaaaatacctgatattattagccgtgacatatgttaactagtggtttctatgactgcttcccatcactactccccacctcagtgatccttagtgatccatttgctcatcaaattgaaactaatttccccaaagcaaggctattatgaatttgaaaaagttgattatttccgagcagataactttaaatgtcatggagcctatttaaagacagctttatagcacaaaccttctgttcaagccttaatgtacaaccaaatggaccaaatgaggcaaacagaatcaggcttccaaatataatcataattctagattagctctcaaaataagactgcagttcatatattctacaaagtatgttttgacattaaatgtaatatactgaggattatttttctgatttacacttgctttggtttctacctttgggtaggtggctctgactgtgaaaaagtcgctgtgagcctgccaggctacatctccctcccagaggtgaaatcatgccctattctccacattgcctttgccttcagattcttatttacatactaatgtttcacaatgtttttttttctcttccttctaaacctaagcagagatatttcctctacctagtgttattcattgtgaggagaggaattttttcttgcaggtgggagagtatagataagggtaataaaattcccatagttttttgttttgtttttgtttttgtttttctgggcatgaactagtagtatttattttcttttaaatcacaaagtatgattgttgtagcacttcttctcagttctattttcttttttaaaaaacaactgtaaattcaattgtacaggcagtttcaagtaatcaaaacgtaatgtattaatcttgacatctgtggtttgtggattcaaatccctacattctctagcttgtaatgtttatgaggtagtggatgtgaagagttcataagtcaaattcacatttaatttgtactggtttcatcattcatcacaaaatatgctactgaacaacagtgagtatgctgttgatatgtaaatgcacaaatatacatgcacacaacatataacaaagcagtttttatgatgtacctcttgcattacaatactcttatgtagctatacaactcctacaagacataaagtaaacacaaaagctattttcttcacttgcatgtatgtagatgtatcctagagaaatgctattgttcctcagaaatggtatttgtaaatgaattttttttaattagacaaacccaaagtactatactatggagtaagtttgtcttattttgtttttaatcagtgaatatagatgactagttcattcacttagtctttcagaagagttttaatatcaaaattatcatatggtctgactttttttaaagcccagttcttacaaaacaataaaatcagacctggtgaggttctgacaactacgagagaaacttagtaccaaatacatatgctatttctccatttgcacaagacagctaatttgtagaaaacagaagactaaaagttggtaaatcaaatgtgttttataattacatctgtgagagaagaatcctcttatgacttctggaaatatcaaaatctgaaatgactaaataactgacatgccaaggaatttgtattctcttgttcttttacacattaggggagaaaatagtaaaaactagcataattgtgtggcaaaatatccatgaaataatattttgaaagttaaaatatggatttaaattaagacaaatggatgtgttttttagatgtgtatgcctaaaagatggatactgtggatatctgatggctttcttgattaagccacaaccggtggacctcacaaatgtcaaatatgttattccaaaatgtcagttgtttagactcatttctcagcttgttattgatgagtttcctttcacatttggaggaatcctgttggggaaactgaagaacagatgttaagtgtgaagtgtctccctccttagttcatattcatatcacattgtttgagctgccacatgtaaacaatatagacactaagccaactggtcctctgcctactgctgatgtggcagaaaatatctaggaggtagccagaggggcatatgtatacctgttaagtggcctggttctccaatagtcgtgcaagtattgctaaatttgtttcgctcctgggaattcaagcttctatttcagattcctaatccacagcattaattatcttttttgaatacccgaagcaatttatgttgcttaacatataataaagttaagtccattattattcctgtcttataattgaggagactagagtctagattatttaagcaaccaaaatcacacagtcagtcaatgacagagcccatgactaaaattctgtctgtccccagatttgtgctcttcagataatgacatttctgcacagttattaatctgagtaaatagagtccatagtgaattattagctgatttcaggagattccatgcaaataaaagtctgtcatatcatgctctgccagtctacattaatacaaatcacaacaacaaggcagtttatttaaaaatattaaaagtaatagaagattgaatggaaggatgaatggatggattgattaagagatagataataaataaattgatgagagagagaaacacacagagagaaagataaaattaaccacactaataaaagtatgatttggtatataacagaaaaagttctttagtttgtttgtttgtgtgtgtaggtattctgtcataaaaacacaattatctaaaacataaagtctcaatcttttgcttaagaaatatttttaatttaggctggttacaactgtgaattaaattttatttttattttttattttattttattttgatttttttttttttttaagatggagcatcgctctattgcccaggctggagtgtggtggcgcgatcttggctcactgaaacctctgcctcctgggttcaagcgactctcctatctcagcctcccaagtagtaatttttgtatttttagtagagatggggtttcacaatgttgcccaggctggtcttgaactcctaacctcaggtgatccgcctgcctcagcctcccaaagtgcttggattataggtgtgaggcaccatgccctgcccaattgtgaattaaatttatatctagaaaaggtgagaaatattattaacgaagacatttctttctatgatacttaagttatacatgtgtagaaggtgcaggcttattgtataggtatatgtgtaccatggtggtttgctgcccatcaacctgtcatctacattaggtatttctcttaatgctatccctacccttgccccccaccccccgacaggccccagtgtgtgatgtttccctccatgtgcccatatgttgtcattgttcaactcccacttctgagtgagaacatgtggtgtttggttttctgttcctgtgttagtttgctgagaatgatggtttccagcttcatccatgtccctgcaaataacgaactcattcttttatatggctgcatagcattccatggtgtatatgtgccacattttctttacccagtctatcattgatggacatttgggttggtcccaagtctttgctgttgtgaatagtgctgcaataaacatatgtgtgcatatgtctttatagtagatgatttataatcctttgggtatatacccagtaattggattactggggcaaatggtatttctagttctagatccttgaggaatcaccacactgtcttccacaatggctgaactaatttacactcccaccaacagtgtaaaagtgttcctatttctccacatcctctccagcatctgttgtttcctgactttttaatgatcaccattctaactggcccgagatggtatctcattgtggttttgatttgcatttctgtaatgaccatttctgtaatgatgagcttttttcatatgtttttggccacataaatgccttcttttgaaaagtgtctattcatttccttcgcccactttttgatggggttgtttttctcttgtgaatttgtttaaattctttgtaaactctggatattagtcctttgtcagatggatagatcgcaaaatttttctcccattctgtaggttgcctgttcactctgatggtagtttcttttgctgtgcagaagccttttagtttaattagatcccatttgtcatgggaagacatttctaaccagcaacaggtccagtatcagggcctttatgtctttgtccacaaagtgagtatgttctgcacagggcagcagtgtttaaggatatattctcttcatggagtaacacccaactcaaactttaatggtaacactttaaatctttccaagctctaaaagcaatttcttctgcttaattgctttttggggactgtaatacatgtgggtattcttactctaaatataattctctgcatttattttcaacatttcttttatggccacttaagtgacttttctctggttatttatgcaatataggtgacaatcctatttggttttctatttgaacattctgtaaaagctgaataacaactccaaaatacaacacaaacatgcagatacatatacaaacacttactgtattttattcaattaacaagtgtgttcactttaattcacacacaactatacctataggcatgcccacacatacaaacacacatacactgtttctcattcctatttcctttgtctgtacttggtttagttatggcacttttgttttgcctctaacatttttattttaaaaagaaaattaaaataggttattgggatcaaagatataagctttttgttactttgaatgatttttgtaattcagaatatgcacttgttatttcagttcttatttttataattattggaagagtttgtctaattaccctataaatccctagagaaaggtagccaccatatactttatttcttggttatatgtataaaaatcagtaggcaatgtaaaaatgtttttgtgtgaatttatgtgagttataattctaattctatgtcaatattcacctcagattaccacatgaaagcttagtcaccaagtatgcctcatactgaaatacccactgattaaatcagttgacgaccagctcctatcttacattcaaatcaccaggatcaatagaatattttcttattatccagattctcaatccattgcttctactcacaaacttctccccatgataaacatacacacatacatacacatctcccagataaattcttatggtcatgacaaggtaatcccactgcttccatttattaaataattgattgaaaatatttaggtgagaaaaatggttgtgtaagagtaatattgttagcaattgctaaaactgaatgtctatgtaccttcaaaattcatatggtgaaaccctagttcccagtgtgatagtattcagtggtgggcccttggggggtaattagttggtgaatgagattaatactcttataggaagagacaccaaagagataatctctttctctttctcagtctctgccatgtcagtatataatgagaaaatggccacgtgcaaacaaagaaataggccctcatcagtcactggatgtgcaagcacctttatcttaaattttccagcctctggaactgtgagaacaagcgttttctgattaagtcacccagtctacggtaatttgttttaacagcctaaagtaactaaaactgcaattatctcatgaatttggaaatggtctgtgtacacattattagtaattaattttggaaaatttactttttttttggtaaatcttagttctcactaaagaatagggatgataacaataccctatccccagcatgtccatgaaaattaaatggtagaatgaatctaaaaagcccgatgtataatgggtataaagtattcaatacatgctgatatttacttcttttcccctttacgagtacatgcaatacggtctgatgaggtctttttaaaactgttcacaataattgacattttacaagtcatatcatgtgatactttttgccaaacctggtctctggcttgatcagttttattttacatttgaaatttgtacttagacttgtgggactactttcttccatgaaagatctaataccctacaaccaaacacttcattatttggaattaaaaagcgaaattctttgattatatctaagctaatttaagtattttaagtatataatgtttaactgttaagtagtttacttcaattattaaaatgactgagtcagagtaaccgattatacttcctaggcacactaggccagatgtcaagaatcaaggacttcattttcagagctggcactcattagctctgggtttggagaattcacttattctcttcattctttctgaatagtttagcattgttttctagatgtgattgagtttaaatgcactatttggaggcttataggttccattcttttagggaaaataattttgaaaaagaaagaataaaaaactctaggtcaaaagggatctatggctgtctcacagcaagagtgaaacactgagatgcctacatggtatataaatattaaaataaagaaggcaagctgactatgaaaaacaacagctgaattatggcaacaaatgaaaaatgtcagtagtatctctactggggacactatggaatggtggggactgaggataattagagaagacaacctgcctacacatggcagcatctactaagacttatgactctgtttatgaagaatatgagtaaatgtcctgatatttaaacacataccaaaaattaagatgttcatgtattttgctaatttgattattttaaagtaataatattttttattcaaacaaatatattgtcagtttaaaggccactgtttcttacgtaataaaatttgctttttgatttgatgcttgaattttttctatgacatcacaagaaagttattggttatacatgaacaaatgcatgaatggaattattattactttcattgacaaatgcttttatatatgtaaaattttcatcttagaaagttattttatgtgtttttagagaactatcctctcttccatgatgcatctttgttagttctatttctttaagtaacattgaagttatttatttttctgtttttgtatatcacattcttattccactaaaatacctatattttcttcagttatgtatgattggatttttttaaccatccagatacatgtcttgtgacataatagaatcttttttattcttagaatgaaagagctaaaccatagtcagaaaacttatgaatttactatatcacagctactatggtgtggtatgtaaattatgtttatgaaaatttatgattattcagattaagtcctgcatatgtaatgttaagatttttttactttatttttctgagaacttgatttactaaaaggtaaataaatcacactaggatataaatatatcattattattttaaaaggtatgccccagtcctcttcttactgttggataagctcgttctgaaaccacagttccagactcttctcctgagtaaataaacatattttaaagcagtggtaaatatctgttttgtctgcaactccatctccaacaagtaatttgttcaacaattgtcagtatgaagtggatgtcctttacatcagctccctagattttttcaagtccattggtgcttcacaacattttttcagaggttatattctagtcactttctttattgtccattcaaaacacttgctgagacctagggtgtcagattctattttgcctgttatttgacattcccttctcttcccaggccatttagctacatatttcctattggactatctgctttggcatttagtaaataaataccgtaagtcactgagggtatgggaagaaatattgagtcatagataccattttctcttagggaattttcctctgaaggcttgcaagtgtggtatagttcagtgtagtgctaccagcttctgttctaaggacacagctaattgggttcctaatccaagataatttaaacagattatttaacctttttatgttagtgtttctattttgtatagtggttataataaaaccatttactacttaagattaagatcctcatagatctgaagaaatattgtactagaatgcttagtgaaaaatgtctgacacataataaatattccatacattttggcctttgctctcattgttatttttaccatcagctctctcaaccttgaaacctggctcagcccctgtggaactgtagtatatcacccctgtcccaaaacgaagacctagaatatttacccttacatggttcctatatccgaggtcccagaaaggtagaagggggaaatgtcacaataatattcaaaatatctgaaagcaaactgttattgttttagtgtgagaatagagcttcatagaatttgacattgtatttccctaaaatattaaacttgtatattctcaacagttatattataaatatttattcaggtatactcaaaatttatccatattaatgataattatttaaatgctctttagctgttcatcaccatattaatactaggaataatgacagctaattttaattgagtacttccaaactgtggcccagttacagtaaaataaacactattagatacactccatcaattattacagcaagtctatgaaacatactgtattactaagccagtattagaaatgaaaaactcatgggaaggatatatataaaacttgctcaaagttacccagctaataaatggctaggacacaattaaacacctatgtagttttctttcctgagctgaaatcctaaatccttggctgtatggcccctcattcaaaagccctaaattggctaaaatttatataacagaaaattcacagaatcatttccttctacttttccactaccagggctgttaacagtcccaagtaaaagggcaaaattttttctacttgagataagaaaaatacagagtgtgacaggtgttccaccaatataaaaacactttaccagaaaaactgagaagggggctgttaaccttcggggaaatgtgggtcttcagtggattcttgctagaaacataaaaacgtagagagaagattttcatttaaaagcctcctcccttcagcaaagtatattctgattccattattgtgttaggctcctatatagttataagtaaccccatgtggttttagaattcttaaatattcacacacatagtcatctgaagaatgaataaatccatgaatgactaaaccaagtttattcctatatcattttcaatatccttaaattatgcttacatccttaaatcggttgcctcattctcaaagcacatagtctgtaactcgtaaacacctgtcggccgggcacggtggctcacgcctgtaatcccagcactttgggaggccaaggcgggcatatcacctgagttcgggagtttgcgaacagcctgaccaccatggagaaaccccgtctctactaaaaatacaaaaaatgagccgggcgcggtggtgcatgcctgtaatcccagctacttgggaggctgaggtaggagaatcacttgaactcaggaggtggaggctgcggtgagccaagatcatgccagcctgggcaacaatagcaaaactgtgtatcacaaaacaacaacaacaacaacaacaacaacaacaaccaaaaaaatatatatatataaaattcatttagtacggaagagtgtgaggaaacagaaagttaaaaaaaaaaattgaaagaccagcaataatctcactttttcaagaatttgttagctctttctgagctccacttaacagttactttcccattcttccctgcacaccgtcaacacataaggactcaaattaagatgatgtatatgtttacactccaaaatttttaaagaaaaaggagagagagagaaaaaagtaaaagaaaagaaacccaaaagggaaaatatagctaaggtgaactggtgagtttctactcagaatccttattattgagcatgatgtattttgttttcttaatttatgtataatgaaaatggaagagaagaattataaatcatagttcatttttatgatcagtacataaataaaatttgagtctttcttggcattcattactttaccttaaaaacacaagagtatttactttttgtgtggcaaagaaggcctaatggggaaccttgaccttcacctcaacttgacagtaaaaaagagctgcttccttccccttttgcttgccatgtgtctgaaaaagactagtagcaagaatatataaagaactttcaaaacttaggagtgaacaaagtcaaattagaaagtgggcaaaagacatgaatatacatttcactgaaaagaatatatgtttggaaaatcagagcatgaaaagatgtcaacatcattagccattagggaatgaaaaattaaaaccccaatgggatttcaatatatacccaatggaatagttacaataaaaaataatgataatactgagtgctagcaaggctgcaaagaaactacataactgctgcatggttgatgggaatgtaaaataacaaagccattctctataacaatttgatactttctttaaaaagcaaacaaagagtttaacaggcaatgacattatgatgcagtaatttcactcctgggcatttacagcagggtaatttttaaaaaccacgttaattcaaaaactttatacaaatattcagaacagctttatttttaataaccccaaactggaaacaacccagacatttttgaaggagtgaataagtttaaacaaaatgtattacattcatgcaatgaagcactacttagcaacaaaaagaaacaagttattgatatagacaacaacctccataaatcttcagagaattatgctgagtaaataaatctaaccacaaaagattatatgatatagaatttcccttgtagaacattactgaagtgataaaattatgagaatggaggaaagattagtggttatcaagggttaaagatgaggtgaaagaggaaaatagatgtggctaggaaagaacaacatgagggattccatggtaatggaaatattctgtatgttgactatatcaatctccacatattgcttatgatattgtactatacttttgccagatgttaccactgggagaactgagataaggttacaagagatctctctatattatttcttataactgtaagtaaatctacaattatatcaaaatttaaaagttattttaaaaagagagttcttaaattaataattcattctcccaaccttagaaattagaaaaggaagactaaactgagcacaaagcaagaaaaacgaagaaataatacagattagagcagaaatcaatgaaatagaaaataaaacaaaaaacaataaagaaatttaaagatccaaagtttgaatctttgcaaagataaacaaaattgagaaatatttagatgatgaataataaaaaatgccgggcacagtggcttacgcctgtaatcccaacactttgggaggctgaggtgggtggatcacttgaggccaggagtttgtgactagcctggccaacatgcggaaaccccatctctactaaaaatacaaaaattagccaggcatggtggcgagtgcttgtaatcccagctacttgggaggctgaggcagaattacttgaacccaggaggtggaggttacagtgaacccagatcctgccattgcactccagcctggatgacagcagcgaaactctgtctcaaaaaagaaaaaaaaagaaagaaaaaagagataatgtgctgactaccaaaatcaggaacaaaggttactactaccaatcctcccccatcccatccaaatatattaattataagggaaatactatgaaacacttttgatcacaaattatacaacttatatttaaggtagaaagtcttaaaaacatataaattaccacagctgaaacaaaaatgaatagaaaatctgaataaatatatcgaattagcaattaaaagtctttcataaggaaatatacaggacttcactggtaagttatttcacatattcaatgaagaaatgatacacatactcagaaaatagaaaaagagagaaacttcccaattcatgttataaggcctatattcaaaggcaaaaataaaaaaagaaagaaaaagaaatttaaaaaataaaaattaaaattaaattacagatcaatatacctcacagatatagacacaaaaatctccaataaaatattatcaaactaaattcaaccatatataaaaatgattgtactccatgactaagtgaaattaatcccagaaatgcaagattgtttttgtattttaaatataaaatgtaatgtaatatactgtgttataaaataaagaactaaaatgaaatgattatctcaatgatgcaggaaaaggatttgacagaatctaacatgaattaataaaaaaaaatagaatggaaattcttcaacctgatagaggacatcaacaacaacaacaaccaaaaacactacattttacagcaatatctaatgatgaaagattggatatttgcccctcaaaattggcgacgtgccaaagatgtctataatgtttactcactaattctatccaatattgcactggaagttatagccaatacaatgaagaatacattgataaagccctcaggaaatggaagtggctgggctcaatagctcaggcctgtaatcccagtgccttcggaggccaagtcaggaggcttacttgaggctaggagttcagatccagcctgggcaacaaagacaaatcctcttctctatgaatttattcatttttttaaattagccaagcatggtggcattcacctctccgtcttaggtactcaggacgttgaggcaagaggattgtttgagcccaggagttcgaggttgcagtgagctatcattgcaagttactgcactccagcctggtagatagagaaagacactttatctcttaaaaaaattaagaaaataattatattcacaatactatacaaataaacccttggaaataaatttagcaaaatgtgtgtaaggactgtatgctgaaaactaataatctaagcaaatggaaaatcattccatgctcatggattgggagacctactattgcttttctagtaattctcccatcatagatctatagatttaatactattgttaccatacattagccatattatatgaacataaatatttcatttgtgagcctcatatctaattatttgttatttacatataaaataattattttaatatgagctctttgaaaagcactttaaaaatggttccctgagaccttggctttcaagttctacttaaactattcagtatgaactagaaaatttagtaaacaaagtgtcatcttctgcctcattatctttttatttggaaaactatgttagactccaaggtattctctctttacttcaatgtaacagaagtaaccagtttaattgttcagaacctgacatttatttaatcatgtcttcttagtgttcaggtttattgtcttcaatgactggatgccagtctgcttcctttttgactttcctaggctcggattcatcagattctctacttgtgccatttggaatggaaagaccctcccacagggtagaggttattcattctctctctctctctctctctctccaccacaatttttgccaagagcaagtcaggtttttggtcaagctaaatttttactgcatgctttccttcaactaagtgtgaaagaaatctattaaataatatttaatttggtctcaaatgtgaaccatactctccaacctagtttttctaccaaataaccatgaactgaaatttacttcatagttttgaccttcataaattgtttgtttccccatttatcttcaattcttatatgttttgaaattattgatatcaactctggagaaaagagtaagtcttacaaccggcataacaacaggtacaattaaagaagtatgttccttaacatgagaagaatgttaacccatttcaatcaaaagtatttcatttttcccatgagtaacactatgctgtgcattgtggagtttacagaggaggtgagatatggtcctgacttcgtggtatacaatttcatttgatagggcaaggcatatgtggtataataaagatatagatgttactgacgtacatgagagccttgtgggctgagttcccttatagaagtggagtctgtgcaatcttgaaaatgggtagcatctggataagaaaagagtcaatcaagtaagagaaatgccccaaaattgcttctatgatagtagaacagcttctttcagaaaaagctacatagacatttaaatttaaaattatagcatcttacaaacaaatatataaataccatttacttttatgtctaatacatttagggaaagtatctaagtcaatgttaaaaattctatttcaaatcctcgcatgcatctcctttcactaattaaataatagtgaactgtgttttgaaatcatcagacacttcaaaattagttttcttttcaaataatgcaacgtagtaaaatggtggacttgcaaagttcttattttactgtgattcttctatgaaaataatgtaggactatttaaaatttttccttaaactttccacaagtgtaaagtaggtaaaacaccacaagcaatatttgctgaattattacaatatattatatgtcttttacttaatatgagttatacactgagaactttttttttcacaataattctccgagatgaagataaagtggatgaaaagttgaagtaaagatgtattcaccctacaagacttaatagtgagtctatgcttaactcaagattgcactggccaagggattaaagaggcagaggagaaactgcttccagcgttgtttcccaataaatcaataaaacttgtcaggtgttttcatccaaggagagagtaacactaacctctatcttcatgtatacattttttccaggcttttggagcttgtcaatgattcctaaacttggctttatattagattcacctggagacccattacaatcccaatgtcaccaggcatggtggctcaagcctgtaattcaagctacacgagaggctgaggcagaagcatccctcaagcccaggagtttgcggctgcagtgagctatgatcatgccactgtacactagcccaggtgacaaagtgagaccctgtccccttctccccaaaaatcctgatgtccaggttatcaaattagaatttttgaaggtaggattgaggcagtgctactaaaagcaatgacaaaaagaagcaagcaagcaaaccacttgatgataatatggaacaaaggttgagaaccaccagatggaaaaagaaaacaaattcattaatactgatcgtctattacctttaaataacctagatctcaagagatcccaatatacaaaagctttggctaggacctgagaatctattataattagcattttcattaatcttaatatctcactcatatcatgcacaaaattcaatgtaagatggatcacagacccaaatataaatgctaaagcttctagaagaatactttgaggaacatcataatgatcttgagtgagataaataatgattttttttcgagagcacaaaatgtattaaacataaaaataaaaattgttaatgtttttactatattaaacttatattcatttattcaaaaaaacctcattacatatataaggaactcctaacaacagaaaaaaataacttaaaaagggaggcaaaatgattgaataaattttcttcaaagacatacaaatagccaaaaggtatatgaaaagatgttcaacgtcactaatgatcaaagagatacaaataaaaaccaaaatatgatatcacttaccacttattaggaggggtaatttggaatttccattccaaaagaatggaaatcaggatgtggtagagttacctgcatacccatgttctttgcagcattactcacaaaacaacaaaatctgaaaacttaaatgtccatcagcacataaatgaataaagaaaatgtggcgtataaatacaatggaatattttcagctttaagaagcaaggacattctgccatctgcaagaacatgaatgaacctggaggatatcatgctaagcgtgataagccagtcacagaaggataaattctgcatgatttcacacatatgagctttctaaaatagtcaaactcatagaaatagagaatagaatggttaggggaaggaggaagaagggttgctgttcaacaggtataaagtttcagttgtgtaagttgcgtaagttctaaagattttctgtgcaacatcacgcctatacttaacggtgctatagtgtacatttaaaaccttactaagaggatagatcacaagttatgtttttacctcaatgaaaaatgaatagaaatgtcacagtgagataacacatttgaaatacacagacctgacaaaatatttctatggaaagtaaataaatcctacaaattgttatgcagaagatacatcactcaattagaagtgggcaaaagacttgaacggtcagttcataaaagaagacagccaaatggggaatcaggaaaagaaaatgtgctgaacatagttggtcatcagaaaaaatgaaaataaaaacctcaatgagatgtcattacatatccaagagaactggtaaaattaaaatggctaaatacctggagaccgatatgggaggatagcttgagcccaggagttcaaggctgcagtgagctatgattgtgccactccactccagcctgtgtgatggagcaagaccccatctcttaagaaaaaaaattggggactgaatatagcaagtgttgaaaaggctatgaaacaaagaaaatctcatacattcgtggtgggagagtaaatttacagctatattttaaagaagtttggcaatttcttataaagttaaactgcacaaatacccaatgacatcgtgattcaatttataggtatataccaaaaataaatgagggtgtgtattcacacaatagagacagatataaaattattcatggcaggttttttttgtaggcaaaaactggatggaacatctataaagtggagaagagataaacaaattataatattgacttacagagtaataatacatagcaatagaaaataaaatattgacacataaaacagcatagataaatctccaaaacatcatgttgagtaaaataggtcagatacaaaagtgtaaaatctgtatgattccagacaaatttgaccagtggttgttactgactggaataaagcaccagaacattttctgtggtagtgaaactgttccttaccttaacatggctggtgtgaatatgagtgcagaaatacataaagttaaggtatacatcttaaatttattcattttatgaaatataaatttagtcttggtaatgcacttccaaaattttttattaaggctataattaattttatatttttatttataaaaatgagtgatatatcacattatatttgaatatttttctaatagaagaccttatggcttaaaattaagtattctctttaataattatcataaatttataatttaataagtgatttataactgcacaataacataacaacaattttatgcttaggtaaaattgtctttattttaaatttaagtagtacagcaactttacatggcttacctaaaccacacagttattaagtgatataattgggactctaatccggggctgtttctaagtaatatgttcatttctctttgaatttataacttgaatacatctttttaaaaaattattaatttttaaaatttaattaattagttaagatactctcaatttattgaagattatgtggttcttgtaacactagatgggttaaagtcatacttttgacttctattatttatgtgattttatgtgatcttggccagtcagcctttttttggtaaaaggggaatgataatatctctcaagagtattgcaagattcaaatgaaattaaatgtgttgaaagcttctgtaagaaatgtacacagtacacagaagaatctccatttttataatttctcaattttccctttacattttcattcttactgtcatctgtctctcactgatgctgctgcttctcatgtagccccccaagtgcagactagttctcaccctcagcgctctaaccactgcctctagaagtagaataagtgtcctcttgcagaatacttctacttccttctcctcaaacccctccagcttggaatctcataccatttgattatattgatcactctcccaatgtttagtcactttccctcattctttgaagtctttacaacctgacttactgccattattttgatatctcatttaaattacttatcttctttgacatttgacctcgtcatttccaacgtacttgctatcttcagtatctagctattcaatctcatgatctcagctcaaaccatgttattactcctaattgcaaatttttacaatctaacttttaagtttcctgccttctgaacattaacttctatctttctagttcattccatttactacaacttcaaaaatactgtgactcatcctggatctacaatctcatacaatatacaatacagtccttatacaattctcaatccaataatctccacacatcctttacttctcagcaaacctaccttcaaaacatttaaataatttttactactgctgttatccacccaggcctagccaacatcatgtctcatctgaatttttatcccccttcctgcttctgcattagccctcaccttcagtctattctcaatacccaagcaagaatataacataatatcatagagatcatgccactctgctcactcacttttaaggacttctaattccactctcagtcattattgtacagattatacagctctactcatgctccccaccaggcacacctctttgatcacagccctgttgctcttccccttgtgcctctgttccatctttactgcacccaacacttcctggtgctctttgggcagcctgggaattgtctctgtgttagtccattcgagcagctataacaaaataccatagactaagtagcttataaatgacagaaatttatttttcacaattctggaagctaagtcccagatcaaagtgctgacatattccgtatatgatgaggccctatttcctagttcatagacccatcttattcttcatatggtggagtcatcatatggtggaagggacaaaccaatcccctcaggcatcctttataaaggcaccaatctccttcatgaaggctctgtattcatgacataatcaccttccaaagaccttaacttttaatagtatcatactggaattagacttcaacgtatgaatttgggggggttgtcaacattcagaccatagcactgtcacgttagatgctttgtacatggtttctctgactgaaaacacctgtcttcaaattcccccctggattgtttccttacctcctggattagttccttctcatgccgctaataaaaacatatcctagactgggtaatttataaaggaaagaagtttaattgagtcacagttctgcacagctggtgagacctcaggaaacttacaatcatggtggaaggggaagcaatacatccttcttcacatggtggcagcaaggagaagtgccaagcaaaatgggggaaaaaaccctgataaaaccctcagagaacatgagaactcactcatatcacaagaacagcagcatgggggtaactgcccccatgattcaattgtctcccaccaggtccctcccatgacacattaagggattacgggaactacaattcaagctttagatttagtgggggacccagtcaaaccacatcaccttcttcaagtctttcactcaaatgctactgtctctgtcatgccttccttatttccctacttaaaattgtatctccttctcgtgttctttatttgctttgtctgctttactttcctccatagcacttagcaacacttaacatattatatagtttaattttttatgttattatatatctccttccaagagaatgtaagctccaaaaaggcatatatttttttctttcctttttttcacaggaaaaaaggaaaggccctgtgttatatccacagggcctacaacagaatgtggtacaaggtaggagcttaatgtgaatgaatgaatgttagtcttattaccttttaagtttacctaattttctaattttctacattttctaccttcctccgtcctttccaccttcctacctcctttgggatgtgcatacagaaagcagcaacattaaggtaagaaagtttaacctttggattaatattaaaaccttgagacagttttgcttttctgttgcctttagcaaaaccacattcctgctgctgtcagttatgacgcactgagaaatcttcagagacctaaactttttccacaagatgactggagaaaaataaatcaccaaatatcataaagatacttgcatgttttgtaagtgattaatgactgctttctcataacagtaaaaactattttgttttgtatgagaggatttttcactctaacttttaaaaaaatcattacatacaaatatatcacatcaaacccaaaagccattgctagcacactggttcctgtcttaatattaagtatgagacaaaaggcctttatcttccagaaagttgtttataacatgccaaatatgtgaacacccaatagtcaaaggacattatctctgtgatgcaattttgaaagttggtaaaataattttttatcaatttcatcctacaagcacataatttaaaccattcttttaaagtggattttagaagattggaagttttagaagtcagtccctccacaaaaactgccattaaactgcaaaaaataagaattaacctttttggaactctggatcctaatcagataaataacaaccattagtagagtgcttgatgctattggtctttagtaagaaagtggctgcatgcacacgccagataacatcactcattcttattcacaagagtcaaaaagtgaaaacaaacctgtatgtgtggataaacaaaatgtggcatgtacatacaagggaatattatttagccataaaaagggaatgatgttctgatacatgtttacaacatggataaaccttgaaaacattatgctaaataaaataagccagacacaaaaggacaaacagtatatgattctacttatatgaaagatcatgaatagtcaaattcatgtagagggaatgcagattgcatgtttccagagcatggaggctggggcaaggggaatgaagaattagtgcttaatggtacagaacttctgtttgatgtgatacaaaagttatgaaaacagtgttaattatacaacattgtgaatgtattcaatatcactgagttttagaattgaaaatgattaaatggtaccttttatgttatgtatatttaccactgggtaataaaattgtattaatgtaggtgaggcaattttaacagttgtaccactctggaggaggatatgataatgaaggaggccatgcatgtggaggcaggatatattacatatataatatatatttataatatatataattatatatatattatatatacacattatgtcagggtgtgtgtatatatatattttatatatataaaaaaacatacaccctgcctccacatacatgtaagacatatatagtaatatatggtatattatcatatataatatatataactatatatatatatatatggtaaatctctatcttcctcttaatttttctgtgaaactgaaactgccctaaaaaattcaagtcctacaaaaatgaaagtgaattaaagtactttttctggaacaaataaacttagcataaatagttaaaatattaagagttgtaattaagggaaatttccgctcaatgtgacttcaacagtttaaaaaacgtattactacaataagaccacggagagaggaattgggagacccagaattgattgggtcagaaattgaaaatgatattatcagtgacccaggtttgaatgtctctcttcacagcattgacttcactaatggatgtgacctggttggcagcagtagcttggacaacatgcttgtttgcagtgggtggtagagagaggcaggttttgctttcccagaaaccctgaaaaaggtcatcaaacctaaatttccttagccttcttccatgagcaaatcactagcagatgattgctagcaaggtgttactattacaatgaacccctaagtatcatagaaagagttagtttggggaaatatcctctccaccacaatcttagtcatttaagtcaatttaacaatatattgaaatatttttcttagaagtttaaagttccattaaagagtaacgattacagaaattataggtagcctttagttccacaagtgacatctcaagaggaagatgattcatcaatttcaaactttccttgcaagtaatactggatgaaaattaacttggcaaacataattaataatcatgggttattaattacttccgcaaggtgggtgtgctgattttaaaaggcttgaataaaacataaatttccttaatttgatactgtaaatggagtaatttggtgatgtaaatggaaatatttaagtgatttttgcgtcagatcttacaacttaaaatatttttctaaaattagtttttgtaccatctctccagcatgttccagcctatatcagtcagtccaggcttctataacaaaatattatggactgaatggcttacacaacagacatttcttacaattgtagaagctggaaagtgcaagattaaggtactagcaaatttgtttcctggtaagggtcttcttcccggtttgctgtatcctcaaacagcagatagagaaagagagagagagagcactctatagactctcttcctgttcttataaggacactaattccattgaagagggccctacactcatgactttgtctaaacctaattaattctcaaaggcctcacttcccaatactgtcacattgtggggcagggctttaacatatgaaatttgaaggaaaaggaatattcagtctagaacaaagccccataaatttcaaaaagctgtgggacaggagggaatggggatggtattcaatagtaccacatccaagcaagtcttgtgtggttaaaacaaatcaatacagtaacatgaaattttacacagaaacctatctaattataaattgtatgcttaccataatcaacactgttatacattgttttaaaaatacttaataatgttttttgtttaaccaaataatagaggcattaactagtttcccagtgctgccaaaagaaattgctacaaaatttgtggcttaaaatagtaaaacaaacaaacaaacaaacaaaaaattctctctcaattataggaggccagaagaccaaaatcaaggtggaggcagaggcatacttcctctgatgcctctagggaagaatcctttcttgcctcttctagcttctggtggctcctggcactccttggcttgtgacagcataactctaacctttgtctctatcttcacatgaccttgcttgtgtttctgtgtcccaactacccatgactcactctaaattcagatgatctcaccctgagttctttaactttattatatctgtaaagctcctatttcaaaataaggtgacatttacaggtactggaatgggagagggtctaggacacagacactcccttatgaggatactacatgacccattacaaggcacaaagtaatcaccataggcaaaccgctagtgagagctcactccagttcggaatatattcatgtttctatgtaagagaaaaattcatccttgcttcagttcatcttggcatcagtacaagggtgggattcagagacatataagtgtggaataccagatcccaccacacttaaaaagctggcatactaagttcataaacaatgtagagtgtgaagttgagttgaaaatgcttatgccatacagtttatgtatcttataatagccttaatcacacttccagtaatgttctccaccactggatgctaaaaaaataaagttagttaaagaattagatagtataaaaaatatatatacctctttgagtggaaaaatgctgtcagcacattttgttattttattccattgtataaagtctcactagtgccctcttcataaatgtattgaaggtttggctaaattgtatcaaatttgtgattaaatacaaatgtgaatactataaaatattacaaaggacaatctgtatactatgctatgccagttttacaattttacaatgacttacagatgccataaatatttactttaagggagtaaaataagttataaaatcatatttaaggacacctaaatccttgaataagtttaaaatggtattattatttacatatgaagtcagctgactattgaaagcttatttttcaataacagaaatatatgcattatctaaaacacatattccaatattttcaagaaacaaaatactgaattaaatcatctgtatttaaatgtttatctattttcgttataaatgtccatgaaaatgcttaaaattggtttatttgatctaaaaagttaatatgcaatttttatttttaatatatcatttttcccatttattcttttctaaataacacgttcatccaaagtagatgactgaagaaacaaaatgctgttttctttatgaacttgtaatacatttcaaaaataattaagatattgttcaaggtgttgaagtgtacaatataacaaattgcatttgcagttgaatagtagcagagtagaagctgaaaaaataaatcatgtatcaaagtagcttaaaacagatgatagcagagcaaagagtttcctgccaacgccctctaaacatcggttcttttaggcttttgtgctggtattaggtttcagttatagacaagacatatatatctgaccttttcctttccttttctacaccttggagtcaaagtctcctataaaaggacatttgcagcaagtattttcagctggagtaggaggaaagggcaggagtaggagagcgttatgatcacctcttgccaaagcagtttcacttgatttgcaactggtgtttggtaaagaattttgctatgcaaaaatagtgtcttaattggattattttaagacaaagtatgcatttttcatgtcgtactagtattttattaataaggctagggaaacctactaaatccctatactaaagtgaatttgattctctccatagaaacttaaatcctcagggtgatacaactcagtccttctactgcagcagctcttttataaatgcctcccaaagctccaagaaggaacaaagaatgtgaccagtaagctcacaccatgagtctatattgcagaatatagactttgttcaacaaaactgcagatgctctgttgaatccactggagattgtcctgatactaaggacaagtatgtaagttaatgattttattaattttaacatttttaaatgttttcctttggggaattctaatttatatatcaatattcaggtaatatttgctgaaaacacaaactctgagaatcaaaatgatctgcattcacattctcattttctattataacatagagacaactactttattatctttttagaaactttcgcaactactttagtttcttcctaattttataaattaatctatctcaaaaaactttgctcaaaacagttagtaatagctatcaacttcagaaaaagtgaaactttaggccgggcggggtggctcacgcctgtaatcccagcactttgggaggctgaggcaggcggatcacgaggtcaggtgatcgagaccatcctggctaacatggtgaaaccccatctctactaaaaatacaaaaaataaccctgtctctacaaaaaattagcctggcgtggtggcgggcgcctgtagtcccagctactcgggaggctgaggcagcagaatggcgtgaacccgggaggcggagcttgcagtgagctgagatcgcgccactgcagtccggcctgggcgaaagagcgagactccgtctcaaaaaaaaaaaaagaaaaagaaaagaaaaagaaaaagaaaaaaagaaagaaaaaaaactttaaagataacttttagaaggaaaatgaaatacagaaataatacatctcatttacacttaattaaaaataatatgaattgtcactatttcctatgaaaacatctcatgccaagttcttttattaagcttggattttaaatgttatatttgagttgaaactggtagaatcttagtaaaactataacaataagaaatttttatattatatatgtaatatacaataatcacatttaattccatttgttagtctattctgattctttagcaggttgattcataatttaccaacttggatcagaaatattttctattcttagcttttgctgtcagcagagataataataatatagagcctgaacaacaaaggattgtgtattgtttcaatttaattaaagttgattcgctgctttaagagagactcacattttatattttatattttttaattaaaaagagaatgtagatatttgcttttccaaatttcccataagataagaaaaacatattttttcttaattacacccttgctaagtcacgctagctgcctgaccttggacaaaattcttaacctctttgtgtctcattttcagtaactgtgaattaaagataataactgtagtatatttctcaagggattattgtgggaattaaataaaataatcctctaaaatgcttagtacagattctggaacataataagcagaaaaaattaataacaattattatttttatttactgtattatgtgacatactttttctttatgaccttcaggagaatttctactcatcttaaaaatgtatatagatattgatctgcagagaaatatatctgttatttcaaggtctgtggattacataatggtcaactctgattgatttactgattaaacaaaattttaaaacaaaaataaaaatattgcagctatgttggttttaaccattctaaactctgatgaaatttgctttctgtttggtttgtgactaggaagataaacattatttattaggaataaaaatttctggtgtctaaaaaatttcaagaggaaaactgttagattctattacaattaaatctgttaagatttaattgcaaatatgtaaataatgcaaatatatcttagggcacaatttttgttctcattaacttacccattttacattttgagaacagtaatagatgaaatacttgtcaaagagaagatctaagatggtttaaagaaaatattaaatgaaatcaaacttacttgtcaagctccatagcacaacttacaagtcataaatcacactctgtatgacagctacggaagggatctgggtagtaaaacaaaatgatggattttatctttcctgtttttgagttgtttttttaagaaaatccttttcagtagatttgttaacagtacataatgaaaatcctataggcataggccccccaaaaaatcacaaggtatacaacacttgtgtcatgcatcacccagaaaaagaatcacatacaatcccacagctctgaaatacaggaatccatgattcttgaatgcaaacacaacctacacagcctctctgtttccaaagacatgcactgaacctcccacatctcccagaatacaaaatacagaagccacataaactcaaatacacaaagaaccacaaactatttttatcaaatacatataagtccacctcacgaactctgagaacacacatatgagtggcaacaccaaattctgcgagtatttcacttcacaacagacacagaggaccactaagtcttaatatacccaaaacccctcatatacacactcgcaaactacccatgaatacacaccccaccctcccagataaaacccatacaatgcaaaaaaaaccccacaaaaacaccaataatactctaatatacgcacacaactttcatatacccatgggcacataaaaactcacaaaaatatccccaatccctgagtgtataaatcccccgaaacactatccaatcaatatgctgcatctccagaatacaacctcctcacctcatcccctaaacatgcccaaacacatgtacgaacatcctagcattctccaaagaaatacactttaaatactaacaatcccgtattctataaatagacttagataattcgtctatctgctgataaatatacacacaaaccagcatatacacccaagatgcatggaaatatctccagcatatcatttataaatacccataaaaacacttcccaatcccaaattatcccaatctagtatgaaccagctcccacattgccaagtactaaccaataaccatatcacatacctctaatacatataaattcaactctcccactctcctgtataaaaagagaaccccatctctctatcagacacacacatactaaattcccagaatatataaccctaataaccacttactgcaaaacagaagcacatagctccacaaaaccttcatctaaactgccacgcccttaaatgcacacacaaactcaatactcatgtagttgtctacatgccctaaatatacccgtgattaactaacacgccacaaatatgcaaacatgccacctcatatccccaaatacacatacagttccacaatactgcccagcccagttatgaccttctttaatctgcaatctccacacagacacaaccaacccacacacgtgaatacatattagattctcaccaattaaatacatatcaaattccaaactaagaattcatataaacacattttcacatacacaaaaccacccccacaaatctcacaccctccaaaatccaaaataaatcttcctgacattctcaagaacacactaacccaaccacccaagataacacacgtgtgtgcagtaaattttagatacatgtgtagcctacaatttacaaataatataccactactttttatttgtaaattccacataagtaagcgattctcatggaagcttttcttgactttggccacactcttgcatccacaaccaacttgtgctaccaagtgaacaaactatgactaaaggcctgttcttccactttgcagctgctcctatcagtgacaaatcagcgtattagaacatgtatgctggctgatcattctgatcaagtcaacaagcttcacaacttactcaatgaggtcgtccgtgagaacttcactgttttaccaggacaggagctacttctttgctgaactgcatcacggtttcaactgctgaggttttcttcaagcttttgcattgtttggaatgtgaaaggcacggctgagacacacttcggcattcccactgcattgttacacctcccccatcacttcaggtccaggtgagcaagggaaagaagcgcggcctgggcgtcccgcagggcccccgctaggaaagctatgaacgctcccgccttgagcgcagccacaggcctgctctgatcacaatgtggggtcgccccgcggacactggtgaccagtgggagcatgaccaggaggtgattaccttctgatcacccttggctttatttttaggtaacaccaaggacgccatgatggcacatgcctgtggtcccagctaccccggaggctgaggcaggagaattgcttgaaccgcggaggcagaggttgcagtgagccgagatcacgccactgcactccaacctgggtgacagagtgagactccttaaaaataaataaataaataataaataaacaaataaataatttaaaaaagtcattgctttatttttaaaaaagtaatagtttcaaaatgtatacatgtaaaatctaactgggaatactttgtacctacttgtagcccaagattaagtttattctcaattactaggaggtttgcacaatagagtacatatttaatctgtatgactaaaagcctcattgtcaatgtgactgtgtcatcattatcacatttgtgaatctcctgattataactttcacagatggtctatctacagggttctgggataagaaacttgctgtctgtctacagaggaagctgttttcacttccagatagttctgaatatttgaaagtacttgctgattcagagtcaaattatgtcttgctgtaacatccacaatttctgaacttacatttgagataaaccaagattagactaaaccatgccttcaagtgacagactctcaaaaatgtgatgcattttttttcaaaaaaaactgcacgtccaggatactctacctggagaaaaacatagctctcattaaccttgtccagacattaaacttataagagaaaatcattattttccttgtagccaaattattccgctaaattgtttttaggcaggattaataaacctttactgtaaagggaaagaggctaagatcttaggttttgtgggccatataatctctatacaactgttcaactctgctgttgcagtgagaaagcatttatagacgatacacaaatgaatgagtgtgtccatgctgcaataaaactttatttacaaaaccagtctattggctggatatggcttgcaggccatactttgccaacccttggtttacagcctggctagctaaacactgcttgttgtagtaaaatcttgctttttaaaacatatgtctctcatcctagcattgtcattacatgtgtgtggtttattgttgaatatgtaatatttaaggatctttcctatttagttttattgactaaaagctgtttcataattataatacacagacatctatataggtttttattttatcattcaacctattagctaatccttagagttgtttcaattttcatgtgtttgacagatgaacatgtctaaaacactgatgaaaatgttaccagaatataaacaaaaatgaatttttccggttaaaaccattttacttgttagtaatatgtaactattaaccattaaataatttaccaaattattccattacgtaatccatattgctccttcttgtccacaagaatatagtaaggtacattatcaaatacatacctctgactttagtgggcatttaatgtattattagaggatcccaatatctgtctttcttaagaaaattaaactcatccctagtgattatacactttcttcatctaacactataatattaataacatttgaaaaagtaatgtcaaataattaacactagatttacagagtatttttagacagttttctaaaattatctgaaaaatttggccagaatcagtgtaaaattcacatctgagcttatggaagccaactttattccactctaaaagtacaacattttatagttttaattttatcttttaaaatgttttaacctaaaggtagtggaagacgttactaaaggaagcttaggtagtaacgtatttgtcgtctcagttaacacaaagaccatagatggggcagatctgcaggatgcaaaaactttcttttttctcacctcatagtagccatatggctactgcaattctctggtttcatgtgcttacaaaatgtcctttagttaaaaacaaaaagaaagagaaagagagaaagaaagaaagagaaagaagaaggaaaaaagatagaggaaaaataatttcttcatgtgtctatttaaattaacaaagacgtgaattgtcccagacctccctgtgatgattaatttcatgtgtcagttttactgggctaagggttgcccacatggctgataaaacattatttctgagtatgtctgtgtttccagagaaattagcatttgaataggtaggctgagtgaagaggatcatcctcaccaatatctatgggcatccttcaatctcttcagagcccaaataaaacaaaaaggcagaggaagggtgaatttaatctgtcttcttgagctgggacatccatcttctcttatcctccaatattggaacacctggtctatgttggtaggagtgtaaattagttcatcataaccttgttggcactagggaccagtttcatggaagacagttttttcatggaccgtggtgtagggaagatggttttgggatgattcaagcacactacatttatttatttatttatattattattatttttgagatgaaatctcactcttgtcacccaggctggagtgcagtggcgcaatctaggctcactgcaatctccgcctcccaggttcaagcaattctcctgcctcagcctcccaagtaactgggattacaggcacctgccaccacacctggctaagttttgtattttcagtagagatggggtttcaccacgttggctaggctggtctcaaactcctgacctcaggtgatccacctgccttggtcttccaaagtgctgggattacaagtgtgagcaaccatgcccggcacaggcacattacatttattgtgcactttatttctattattattacattgtaatatataataattatacacctcaccataatgtagaatcagtgggaaccctgagcttgtttttctgcaactagaggtcccatctgggaatgatgggagacagtgacagatgcacacactgcagggggattgcattagatcatcagacatcagattctcataaggagcgtgcagcctagacccttcacatgttcagttcacattaagattggtgctcctatgagaatctaataccaccattgatctgacagcaggcaaagctcaggcagtaatgcaagtgatggggaatagctgtaaattcagatcaagcttcgcttgcttactcactgctcctactgctgtgtggcccagttcctcaccaggccatggacctagtccatggcccacagggttggggaccccgatctaatgtgacaactctggaaatcagattctataccccctatttgttgttgctgttgttgctgctgttattgttgttcagtgtctaatgagctttctgaaataattttgtagtctgggactactcttcaacactcagccaggcagtttacatctctgccttagccttcacttcctgcttgcccagagcctcaaggccagtcagaggtgagagctttgagccttcccaggtctttactgaacatgtacgcaggcctacacttgggagtagcctcatagatttctaggaatcattctgttggaattttcaaagcccttatggacatctcattctcctgttttacttttaaagctttttagttagcctattgtctgcccaaaatgttatctacaacctcatacaggcaccaacttgaataacggcctttaaatgtttttgacaaatgccattaaggaaaaggctttttcgttaagtgagctcttaggacagaaaaagacatcctggcagtgggatgtttctgaaaaccaccagccaagtcaaatgacagttctctgggaatgaggctttgaaggaaatccagccccattctgtctttccagtggctgccaggctattggtcttcactgtaattatgggctgttaattttcaaggctgcagtggagccagcgaggagaggatgagaatagaatagggcaagttaaaaataccatactgcttgctgttcttaatgagatttttcattttatttatttgtgtgtgtgtatatatgtacacacatacacacacacacacacacacacactgaatggaaaataaatcttggggccccaaaatcactaagctaaagggaaaagtcaagctggaaaagggttagggcaaacctgcctccaattctattcaaagtcatccctccattcactgagataaatgcatatcggattgcctcctttggaaaggctaatcagaaactcagaagaatgccacttgtcactcacctacctgtgacctggcagccttctcactgcttgtgctgtcccacctttcttggcagaaccaatgtatatcttccatatattgattgatgtctcatgtctccctaaaatgtataaaaccaagctgtgccctgactaccttgggcacgtgtcatcaggacctcctgaggctgtgtcacaggtgtgcctcctcaaccttggcaaaataaacttcctaaattaactgagacccttctcagatattcaaggctcacattttggcaaccatgaagggattctgggtggaggctcccctgacctttgacaaatctcctatcagtgctcggtaccagcttgaactatctttatggctcaaaccaatagaacaatttgccgagacaggcctggaagcaccccctccagagaatcactgatctttcaaaacttggtcaagatctaaagtttattttgcagtacaactccttttttttggagttttactatcttccaacgcaagaaaggcaagtttttcctgctttgatgacgatgaaatgcaggtaactcctttatggagtttgagcttgcttccaacggggaagacaaatgtgagtttcttccttcttctagtaagggaggagaccacccctcatatcgtcttatgcccaatttttgcctccaaagaaagaagtaaaaactaaaaggcagaaatgaaatccacaggcagacagcctggcgccgcaccctgggcttggtagttaaagatcgacccctgacctaatcggttatgttatctatagattacaggcattgtatagaaatgcactgtgaaaatccctatcgtgttttgttccaatctaattactggtgcatgcagcccccagtcacataccccctgcttgctcaatcaatcatgaccctctcacacgcacctcttagagttgtgagcccttaaaagggacaagaattgctcacttggggagctcggctcttgagacaggagtcttgccgatgcccccggccaaataaaccccttccttctttaattcggtgtctgaggagttttgtctgcagctcgtcctgctacactaggatggtaaagagcagtcttcagcctgagacccatcccttacctaaggatgggtaactaaactgggggttgtcttggctaaagttaagattaacaaccagctggttgtaatttctctttaccattagagcactcagtagttggataagttgtgccatctttgttttgcttaattgtttttgttgttgttgtttgtttgtttctgtttttgttgttgtttcagtctttttgccattgggattgatcaactctatccgacttgatcaaatccaaaggaaacttccaaattatggggaacaagacctctgaagtggctaaatttccacactgtggtgggggagaaaaacagccaaaaaaggggaaaaaaaaaaacagggaagattttttactttgactacttaaggggctttatttacataacaaggccacctttttgctagccaggccaaactgaaagagcaatggctgtcactccatactgcagttccatagctaagggctctggcttctttttttccaccacgacagcttgggtgtggttcctaaatcaagccattttcggtttgatacttggtacttctgaaatagcagcaatttgttctagctgaattatggtaatgagattttaaaagatttttttaaaggagctcaatgattaaaagtcagcttaactaaaagctaacatccaagatgtgtgtgtgtatgtgtttgtgcatgtgtgtgtgtgtgtgtgtgtgtatgtgtgtgtgtttgtattgaaaaggccttcacatatttttttttttctcctaggaccttgtctctcttttttttttttttagttaaagatttttttttctcagttgactgagttctgttttttgttttgttttgttttgttttatttacttctgctgcctctcctttctcttgcaccctctgctgcttgagggacctaaactattatagtttataatagcctggctttccttcaagaaagcagagaaggcaccagactcctttttggggagaaacctgtttttccttatgaaaccccaagagtgtaagcagataagttcatctcagctcttaaattgcctgcttttgtattgtgttacctgacttattgactaaaagagttgttgcaccaaagcctcctctggtttttaaggaagagtgtagtttacacattagaagtgtcttcgtttaaaaaaaaattttaagtgcactgtaaaagcatcacatggtctagcctcataataattctcccttttgggagattcaggattcagtgtgggctctgcccagagctcagagatctagtcaaaagacaggtatttcctacataaataaaattggtctcttcatataatcctatgacagatttcttttttttttttttttttctgagacagagttttcgctcttgttgcccaggctggagtgcagtggcgcagtttcggctcactgcaacctccacctcccgggttcaagtgattcttctgccttagtctcctgagtagctgggactacaggtgcccaccaccacacctggctaatttttgtatttttagtagagacggggtttcaccatgttgggcaggatggtcttgatctcctgaccccaagatccgcctgcctcggcctcccaaagtgctgggattacaggcatgagccaccgtgcccggctatcctatgatagatatctgtaactttatgtttgatttggcatccctcttttgttttgttttgttttgtttgagacggaggctctctctgtcacccagcctggagtgcagtgacacaatctcggctcactgaaacctctgcctcccaggttcaagcgattctcccacctcagcctcccaagtagctggaattacaggcatatgccaccacacctggctaatttttgtatttttagtagaaacgggttttcaccatgttggccagggtggtcttgaactcctgacctcagatgatctgcccgcctcgacctcctaaagtgctgggattacaggtctgagccactgcccctggtgtagtacatggttttactgcatgtgactagtttacatgcaactagccatgcaagttcagtaacccaaggcggtctataccctgttcaacaagaaccatctactaatgacacttctggaagtctgggcaatgtcaacttgctgtaaaagttcccaaatgctctcaattatcatatgataacaaaggtctcaaatcagtaaattttgagtggccctttactaggaataatcttgaataagctagtactgccctccacaaccacaattaaaaatatatcggtattggttttctcttcagttcaagaatcatgtaaatatgtaatgtagaaaatgaggatttcccatattcccacagaatcacaaagatgatcactggtaatatgcgtgctacatatatgataccaggtttattctactctttttttttttttgagacagagtctcactctgtcgcccaggctaaagtccagtgctacgatctcagctcactgcatcctctgcctcctaggttcaagcaactctcccacctcagcctcccaagtggccggaattacaggcacctgccaccatgcccacccagctaatttttttatatttttagtagagacgaggtttcactaagtagaccaagttggtcttgaactcctgacctctggtgatccacccacctcggcctcccaaaatgctgggattacgagcatgagccaccatgcctggccatttttttgtacttttatacaattatatgcttgctttataaaaatgaacttattctacatatacatgttattacattattaggacatgttcccaaatgacatattacattttcatcattcttttttaaaatattttttcgtgagacagtgtcttgctctgttgcccaggctggagtgcagtggcctaatcacaggtcactgcagcctgaaactcctgggttcaagggatcctcctctctcggcctcctgagtagcccagctaagtttaaaaaaaatttttttttggcctggcatggtggctcacgcccataatctcagcactttggaaggccaaggcgggcagatcacttggggtcaggagtttgagaccatcctggccaacatggtgaaacaccgtctctactaaaaatacaaaaattagctgggcgtggtggcaggtgcctgtaatcccagttacttgagaggctgaggcaggagaatcgcttgagcccaggaggtggagggtgcagtgagtcgagatcatgccactgcactctagcctgggtgacagagcaagaccctgtctcaaaaataaataaataaataattaaatatatatatatatttaattatatatatatatatatggagagacaggtctcactatgttgcccaagctggttttgaactcctggactcaagcaatcttcccatctgggttcccaaagtgttgggattagaggtgtgagccaccatgcccagacattttcatcatcctttttttttgagacggagttttgctcttgttgcccaggctggagtgcaatgtcacgatcccggctcactgcaacatccacctcccaggttcaagtgactctcctgcctcagcctcctgagtagctgggattacaggcatgagccatcacgcccagctaattttgtatttttagaggacacagggtttctccactgtttttactagaccttgatcacatcaaaaagattgtgtctcttccatttattgtgcagcttgtacacaattgacacaatgaggagctcagcaaaggacgcagagtgacagcatcctcccttcagtggaatggccatgtctagacacctcttaatcactcccgagaagtagggatgggttcggtgtatgagaataagaaacggagcctccagggttgagacaatttgcccaaaacacacctcttgtgggaagtacagttgcgatcccccaggtctcttgggcttgcaggttcctgctctcccgtgggcccccaggagatgttggctgccaagaggaggaggaatcctcctgggcagaggttaacttttgccactccaggatttgcccaccctggggtccctgccgggaatgttcccccagcaccaccctccccatgccgcctcctaactggctgtgtccttcccaccattcagcaaacacatcctacatccaggaccagccccttcatctcaggaaggctgccatgggactcccagaacccccatggctcctggagccctgagggaatcacatcttgggtggggagtgatttgttttctcatccagtgcaaccttggaggtaacagacaagaatgtcctgtgatgcgaagcacttattgtcctgacctctggtccagtgcccttcgctctaagcacatagcatccccaggctgttcctggaggtgtgggctggggtttgtagggactagctggaccagctgggccaggggaggcagccatgcccggggcacatagccactgcccagagctgcccccagagctgggagccatcttgcacatggtgctgtgagatgccctccagagaggaagatggaagctgtctccgtgccccgggactgatgaagggcccattccaggcctttgggcacccgggctcgctacccttctgggagccctgtcctgtgggccaggacaaaggtgccctcactggtggcattctcagaagctcagccactccccacacatgcacataggggcgtgcccacaccaagccacgtgtgggtgtctggggacaatgagtcttgggggagggggtgggtcccttccagaagggtctggccaaagtccagttatgaaggtgagctgagatgggctccctcaaaggagccatagtgtggggagccccgggcagagcccagagagaaatgccagccccgagaccgagacacgctccaaggagtgctgccaagagcagtagacacagccgctgaggcccacggggcacagtgaggctgtgggagagggtggcccctctgtggccatttccctgcctgtgctcacatcccctcctcaggcctgtctcaccagctcttgcagcccatgacccacattctgtctgactctccttcctctcctggctacagggatccccagtgcccctcaccattccttctggtctctcctctgcctcccggaactgttccccaggactctctcctgggtcagcccttcctcccactccacatcagtggttccgaaccccggatgcctttgggatcagctgggtgcattttaaatccttccagcccagagccctgaggcccaagtcacccccgcctgctcctgtggcaccccttggatcagccaaccattttatcatcatccatcacgtcccctgtcaccaagagcctctggcatgttctgttgtccccacgcccacactggcacccctcatccaccaacctgtgcccacgtcctgccttgagcctgtttcccctcctgagtggtgtttcctcactccaagtgggcactgaggcagctggcagacctggctgtgagcttctgtcccttccagaaggatcctcccctccagattacccagtcaagcttgaccccatggtgccactgagacagaccaaaagagggtattgaagccacacagtcccctgagccccactgagctgcaccagctttggagctggagacagcccgggagactgagcactgagtgctaggtcaccatggagaaatcattgtaaccttccctttctcccactcttgagggccctgggggaacacagcgcacaaggtgagtggtggaagaggcatgtgcttgggtgcttggcacctagccggggttcatttctgtgggttcccaagatcccagccacatgtcccactcctgcctcacaaagtgacaggaactccctgttctggaccctgagctgagtgtcagatgctgaccatggagaccctgactttgaggggagcacagactatcaacacagtcctgtgaacacagagagaagagtacaggaggatgctgtttggagcacaaagggtgtggtgtcgtctactctgggacctgggtgttggaggaggctgctgtgaagaaggaaccttccgctgggccctggagaatcacaagcatcataggagttagccaggtggaggttgggggtggaggcatggggtggacatggcgggaagtgaaagtgaggtaagggagaacttgagggcccttctgcactgacagggtgagtgcatgggacagggtgagtgtgcactggaatggagcgtgggtgcaagagacaaggcatgtgtgcacaggagggagcatgtgtgcatgagggtggagtgtgtgcacagggatgctgtgtgtgtacatgaggatggagtatgtgcagaaggatgaagcatgtgcacgcagggccagggcatacgtgcatggggtgtgtgtacctggggactgagcatggtgtccagcctgttcctcctaagtagtgggcaccagctgattcctcaatgaataaatgtcagccagaaagagaggagatgcacctacaggctcacagcaggagaagcataatgcattggtgagcgtgtttccacaggggacaaggagggtggcggaagaggcgtatgggtggggtgctgggtacctagccaggctgtgttctggtgagtgagcccaaagggtctgagatcagctgcaggcatcctcatctctgcatctggaccactggacctcagacatctcagggagctgttgagtaggcaattggagagaaacttctggaactcaagaggaggatgggggtggagccatggcctcaggcatcatcccaggggtaatagtgaagccacagatgtgcctgagagctgcccagagagaagccaaggccatccaaggcaaagagcagacactcagaaaaccaggggagcactccgctgggaaagacagggccaggggtttgcaagacacagcagagcgcaggctacgtctgaccagtggctggtgagattcacagacaggggccactttgggccactgcaggatgtggagggtgctgggcgtcaacgggttgccctggagggtaggagggaggcaaacagctcctgtgggcaacagcggtggggcaaggggctggggtggtggctgtactggaaggggtgagggccagaggacaaggagggagcactctgggagtcctggagaggagagtgtgaagacacaggagaaagagggaaaggagatcaggcaggaaagatgagggaggggagtgggagccagggcctgactggagactcgacttctgacttccgacttccgacttccgacctccaacttccgttaggaagtgaaacaaaggcgaaggccctctctgtcagggtactcagaggaaaggtcagggaaccagggcatgtgggagaagagtgggagtcctcccagtgttgtggggaaggtgtctgtttagctggaggtgagattctaggtccggtgtcggggaggtggtgagtgtggaggccgggagattagaattagtcattgtggtgcaaaagggaaattaacctacagaagctgtccagcgccagcgtgagtatcagtcagaggctttgagcaacccagtgctctagaggaggtaaagtgaaggcttccctggtctctgacatgaacttgttctgactccccttgtagaggcccaggaatgtgtcctgccttgtccacaggggaaggcctccaccctgctcagcctgcctggcagaaatgtcccccagccctcctggagccttagccccctgaatgtgccccacagcagacagctatcagattcctccacaggtgttcactctgtggccgggcaagtcagccaatttaaaccgtatatgtttgcctgtgtgtatatgtttatgtgcgtgtgctttgggatgtatgtttgcctgtgtgtcgatgtgcatgtgtgtgcgtattatgtatgtgtgtgtgtgtttgctgatgtgtgtgtgtttgtgattgcatatgtttgtatgtgtgcatgtgtgtgtgtgagtgtgcatgtgtcagctttgccgtctttccttcaacctctggctgctgcagatggtggagtgagctgaagatgctagagtgagctgaggctggtggagtaagctgaggctgatggagtgagctgaggatgctggagtgagctgaggatgctggagtgagctgaggatgctggagtgagctgaggatggtggggtaagctgaggatggtggagtaagctgaggctggtggaatgagctgaggatgctggagtgagctgaggatgctggggtgagctgaggatggtggagtgagctgaggatgctggagtgagctaaggatggtggagtgagctgaggctggtggaatgagctgaggctgttggagtgagctgaggatgctggagtgagctgaggatggtggagtgagctgaggatggtggagtgagctgaggctgttggagtgagctgaggatgctggggtgagctgaggatggtggggtgagctgaggatggtggagtgagctgaggctgttggaatgagctgaggatgctggggtgagctgaggatggtggggtgagctgaggatggtggagtgagctgaggatggtggggtgagctgaggatggtggagtgagctgaggatggtggagtgagctgaggctgttggaatgagctgaggatgctggggtgagctgaggatggtggggtgagctgaggatggtggagtgagctgaggatggtggggtgagctgaggatggtggggtgagctgaggatggtggggtgagctgaggatggtggagtgagctgaggatggtggggtgagctgaggatggtggagtgggctgaggatggtggggtgagctgagcatggtggagtgggctgaggatggtggagtgagctgccctgctagacactccttatctgctcccagcacacaacatcctgtttctggtttccatctcggtcagtggggctgcagggcagatgctgctcagatctgtctttggagttattccactttttgtcttgaactttctggttgtgtttcatttttcattaatgcattttagaacttcggtccttttaaaactctgcatttgttataattagctgttcttgtcatatagttttattcctttatctttttttgaacattttatacacccttatttcaatgttccttttagatcactctattctctttactctctgggctttgaatctccttgtttcttgtatctgctgcctctctttgggatacctgggagtttttcctctgacctcgtcttcagtaggaaatgattttccatgagaatcctggttcccctggatgaggacggtgtctcctggggagaatgtcctgtttggttttgctggagcctggcaggttctctcagttgcagatgggtgtaatgttagctcctcagctcagagtttctgcaccagctcaccgcagacttgggccctggtttcccacagatgcccagggcagggggccttcctctgtgctaggtgctgctccgtggtatttgttccacgagtctgcaaacattgttttgaagtcagtttgtaacatctgcctagtaaacaaaagtaacacttgtgtctcctggaaaaatggactgtcaccacccccttctcttcttcatcccagtcctcagggaggcccctgagccactgatgtctgaggccaccaaggcaggaagaccctggggagagggtaaatgggagatgcctctcagcccctgtgcctgctgtcccctgggccccagggtagagcttctgcagactttgttccttcccatttctgagacagcctgagctggggccaccctccccttcatggagtcccagctgtcaaacaaacacctccagggccatctgttctctgagcaagagttttcctcctgggatgcccccacccacccacagaagcagggatatagggaaggaaggaccaggatttctggttgcaataattgtatccgtgagtttgagactcccaggttacctttggacttatgagctgaactgctgggcattctggcctggatgtccctagagccccagaacctccacaaggatcatgagcagggggtcactgccccagaaccatgagggcacccacatggtctaccctggctcctcactcatcagaggaaatgacgagattccaaggtcccctccggtattgcaagctggcctgagccatagggtcctgtcccagcatggcatcaaatgcctggagctcatcctgcaggagcagccatggcggagcccccaggtgtgctgggcagggaggatgtgtggaatctcattcactctggacagctgtggcccccaaactacccataacgatgcagtccagccggaactggggccttttggcttcataacatgttggagtctttccccagagccccattgtcttttagaaattaccacttagagagggtagtgcttctgataaagacaggcatgcactgaattgtgtcctccccaaatttatatattaaagtcccaacccctggttcctcagaatgcagctgtactgtggttggagaggatttgtaaaggttaaattaaacaaagtcattagggtgggccctaatccagtacgactggtgtgcttataggaacagtttaggaaacagacatgcacagagggtaaagcatgggaggacacaggaggaaggtggctgactcggaggaaacgaccctccccacaccttgaccttggacttgcagcctgcagaattctgagaaaaaaatgtctgtttttttgtcacccagtgtgtgggactttgttttggccacctagtggactaatacaatggctttgctgttaacagcccagacccacgtttcctgcacataaggcatgggactcactcatcccctctgcccaggcccagccctggtctccgagctgagttcactgggtaggctgcaggcagcaggcaggagtggggcctgatggaacgggcgatgctgaggcagtgagggcggcagagggatgctcactggctcatgtggctcagcttcgtggaagcatcaggagcaggagtgaaagaagcaggtgacaggggccactcatggggagacagatgggcaggctcctccacatgctggagacaactttgggggcacctgctccacctgttgccacatcctcaaacttccccataccccatgctggatccagcagcagccctgattgtatggtatgaccttggtggtcagatcaggcatggacagcttgacccagactatgggatcagaatctctccccagcaacgtggccatggggtcatctgaacagaggatgagcaaccgcagacttcagggctactagcagccaagtacacagagaggcagaggtggggagaggggagcaggtgcagagggagagaaggggcagagctgaggccgcatggcccagggagcagggaaacctgaaggagaccccaagcaggggtcctgtgggctttccaatgtctggtcctgctgaggcctggctgcccttgtgatcatgagctggcaacctacagtcactacagccctgtccttctggtctcctcttgggtcctgcctctgcacagcctgtagccaggctcaggctgggatctcccatatggaccctaagacgggctttcctatacttcccatggaaattctccagctgatagaagaagtgaacactgatagaagatgaacagctgatagaagaagtgtgggggttttctcaagtggtctgtaaaatttttgcaaggtttgtggttcatctcaaagattcgtaatttcgaaatggaagtcttaatagttagggaaatttttcacataccccgaagggctcctctttctccagggttgggtcaaagtcttgtgtccagaagccccctggtcggcagtcctcttggcttcccctatcacccagtgtccagcctgcatgggcccttcagtcccaggggccatggtgaggctgggtccctgggcctggcaccatctagacaccccttggtggtccagtgatgtgcaagctacatctctaaccccctgacctctgccttctctacctccctgcccactccctcattcagagacactgagcgtcacctctcaggagtttccatcttaacgcaagatggaagagagtttcacttcaggccactgttgcccactgtatcttagtccatttgggctgctctaaagaaactaccacaaactgtatacttttcaaacaacaggaatttattttaaacagttctggagtctgggaagtccatatcaaggcagattgagtttctggtgagagtcagctctctggttcattgttagcatcttttggccaacaatgtctcctgtgttctcccacagtggaaggggtgaggcagccctctggggcctcttttataaagacactaattcaatccatgaggctccaccctggtaacctaatcatctccccatactcccacttcctaccatccctttgggtttaggatttcaacatatgaatctttaggggacactaactttcaggtcatagcatttggacttacaccattgcctcacccccgcccctctaattcttgggccttcggactcagactgagtcacaccactgacattcttctttctctagcttgcagatagcaaaccatgggacttctcggtctccataaccacatgagccaattcttaataataaatctcctcttacatatacatatacccgtatatatcctattggttctatttctctggctatccctggctaatacacactgcaagcacctgtgcaataccaagggcctggccatctgcttgaaatgtaaaatagaaaacacacccccccacacagagagagggagagagagagagagagagagaccctgtccagagccacccacccagtgcctgtccctagaccaaggcccagtccccttcacctgtctccatcataagcgtcaccagcctgtctgacaaactgcccagcaaagttattgacattggcctggccgcctggggatgcaaggccctgaacattgtagagaatgagatgccaggcctgatgcacatgtgggagctgtactcggcctccaagccactagagggcaaccacagtgccagctgcctgcacatgaccatggagatggccatccacattgggtccctcatcaccctgggtgccccagcagcaacatcttcctcaccctggaccatgtgttggctgccattgccaaggctggcattccagtttacacctggaagggcaaaagaacgcagagtacccatggtgcatcgagcagtcactgtaattcagggatgggctctcaacattattctggaggatgggggtgaccttgccaacctcttccacaccaagtactcacagctcttgctgggcatctgaggcacctccaaggagaccatgacgggtccacaacccacacaggatgatggtcaatgggatcctgaaggtgcctgccatcaatgtcaatgactccctcaccaagagtgagttcaacaagctctatggctgctgggagtccctcatagatggcatcaagtgggccacagtggtgatgattgccggcaaggtagcgatggtagcaggctatggcaatgtgggcaagggctgtgcccaggccctgtggggtttcggggcccacgtcatcatcaccaagatcgaccccatcaatgcactgcaggctgccatggagggctatgaggtgaccaccatggatgaagcctgtcaggagggcaacatctttatcaccaccacagcctgtgtcaacatcatccttggccggcactttgaacagatgaaggatgatgccattgtatgtaacactggacactttgaggtggagatcaatgtcaagtggctcagtgagaacccttggagaaggtggccatcaagccccaggtggccgggtactggatgaagaatgggcgccacaccatcctgctggctgagggtcggctggtcagcctgggttgtgccatgggccaccctggctttgtgatgagtgactcatcaaccaggtgactgcacagaatgagctgtgaatccacccagagaagtaccccattgaggttcatgtcctacccaagaagctggatgaggcagtggctgaagcccacctgggcaagctgatcatgaaattgaccaagctgactgagaaacaggcccagtacctggggcatctcccctgattgccccttcaaggctgatcactaccgctactgagagccaggcctgcatttcaccttccagctgctgttcttgcccaggccctgcctctccttcttaagagcgaatggcaccaactttgtgattggtttgtcagcatcccccatggactccccagggccgttcactcagtttttggcttctgctgcacccctcatactattccaagtgagtcaggggaactgagagtcccctcctcaagcctggtcatggtggaagtatgagggagacagccacagggaactgtgagctcaatggtcttggaactgctcactaagtcagtccttccttaacctggatgtcagcagtggagtcgcaaagcccacgtactttaccatctaggccttcacctggcctgtggacttataccctgtgcttggtttatggttcagtcattcctcagcccgtgacagatgagaaggaactgtattgaagggcaaggaggaactgtttcaattttcctgagagcttggcttaatgctggaccttctcttaaacctcgtaacaatgagattggtactttcagtccctgtttcacagggattagaatacactcttaagggacaactgagaaagaacagagaagtgacagccagaggttgagaggggccagaaaagcataaaagcaggcacagatcagccaccactttgtaacaagagggttcctatcacaaccttgggtcaaaaagagaataatttggcttataatgtttataatgttaaaagaaagcaggaaggtaggtaaataaaaatctcaatgccattaaaaaaagaaggaaagaaaaaagaaacagagagggagaacacaaaacggaatgaatgtttcaatagatatctgaccaggtatgcaaattacccagcccagcacaggcagaagcactaggcagtgcttgagacatggagttcccttctgcccctctgtctccctctacatgctgggcctactcagggaatcctggtgagagatggagttcccttctgcccctgtctctctctacatgctgagcctactcagggaattctggtgtttacagaaggggtcagaggaactgcatgaagaccacagctttgtgtagacacacaagcttcaacacaggcatgtagatgtgtggttgtatatgtgtgcatgcgaggagttttgcagtcatgcctggtgggagtctgggggaggctcctggcttcaaagagcccaagccattagcccaggcttggagacttgagctgagtgattggagggaggggctgagcagcaagctcaggaatagcccaggccggccaggaggacagtttacctaaccgtcagtggtgagggagcctcgccccagcccagagctgggtccactggccagccaggtggaggggttccttcaggctctagtgatgacctggcaggaagctggggacatgctctaggctgttagcctctgtgagaggcaggtggatacttcccccatatccccactcctggttgcagattctgcacttgcggacaggaaccgagtgcccagtacacttctgcagacagctgctctgcattgactcctgcttcctccacttaaaagttgtgggatgttaagcaagttgctataaattctcagacctgtactttcctaatctatcaaatgtgaagaaagcaagccaaggtcacaaaatattagtgagtctacaacaattcacccgcggtgatcagcagcacatacccaaggaggataaaagaaagttgataaaactccccggtgttctgatgtgacgtccccacctcctaggaccaagggtctagcacagagtagaagcttaggatgtatcaaggccccattgagctctgggagttctggctctgcccactttaatgataaatgatcagagtgctgcactaaggcagcttcaccattaagcagccatctgggagggcctggtggttcagctcccaactgcggaagggggcaacctggggaagtgcacagggctctggactagagccagaagactcagctgctaaagcccagcccagccctcctacactttcctacacttcaacccacctgatgcctcctctcttggaggctcgagcccctggtggtgggtgtggggtgggggatctaagggctcaccttgtcactaggcagtccctgtcccaatcacctccatgcctttttgctggggcttgtgggttgacagttgaagtttcaggaccccaggaaaagtgccttaaataacacattcctgcaaacggatagccatttattttcccattgattggagatggttgcggtagcacatcctatgtgggtctggttcctgccgttattctctccctcaccatggtgttccccagaggactccctaacaaaagaaacctcctacgtgtacattttcctctccagtctgtttctaagcccctgtgaggagttcagctaatacaggtgtgcagactgggtgtgcacatctgcctccaaaagtcccaccagggtcttgccatgaagggagccttccctggtaggttaggaaaaccagtaggagagctaaagctccagggtccttgccctcagtgattggtgccctagcggggactgggcactgtccacaaatctatccccaactccttcttggatgcacagctactaaattgtagcctcccctgcagctcagcgggctgtgtctgagctcatggcagtggcaggtgcacatgcctgtcacccagcctagccctgctccttctgtctggctgataagaagctgatctcaaaagaatgctcttgcctggcagagcttcccctgcatattgaggtccctgaatgaccaacggaggcctgcagtgcccctgggggcctggaccctctctgtgccatcccaggggtgagcagtgccctggcttcttgtgagcttccatgtggggctactcgttacctcacctgctctggctcattccagctctacaggggtgcttaacgtgacatccattggactctcagaaatgtgtgttcttatagttctggtctaaaataaggaataaaaattgcccaccgtgttcccttttgtacactttggttttgggcagctctgatgtgagacttgttttctgaaattatgctgcccctcccccgaggagggggcaatggaacagtggcagccaaggagtagaagtagttagttggcacctctcaggcatcaaaagagtgagtaaatactaacacttcaaacagatcctctaggagagcacgctgaaattcaccagagacatgatgggaatcagacagcagaggagagggaagcctgccgagctgggacccccatggagcggaaaggggctccctaacacagggaagaggtgagcaagtgagagaaccctgaaatttcacaactccaccatggaccttcacaatcctagtcacagggagccctctcattgcccccgggcctccagatgaacacagggagcctgctggagactgtgcagaggcactgctcaagcctacatggatcccacaggcttttcatccctgatctgcctggtgcagctgctgctgcctgccatggaggggaactgggcactttcgtgtgccccaaagacagatactgcagctgtggtaaggaggagtgggtagacaaggcttccctctgctgctcctctctgccaaacgggacttgcctgctttggtgacaggctgccagtgccaccgcccacccctgactgagcatgacagccacagctcactgttcccctgagaacccaacccccagaggctgcccattagcccgttccaccacaggcttgcctctgctgccccaggccaggaagggagcaggaaggtcaggcaccttcctgagctcctaacagcaaaatccagctttgggagagaagtgcaagtggaccatgagcccaacaactatcattgctcattgccccagctgaagattcctgccctcctgggtgaacggtgcacagcacagccaccctgctatgcctgaacattgcagctgtggcctggagcccttcggaaagcccagcccccacagtcctgtgatctgttctcaggctccaggggatcagcccacccctccctatcacagccagcacctgaactctgggctgactagatcctggtccagccacatcaggactcctacatgccatctagtgggtcactgagaggtgtgggagttggggaattacctagcccagtccaacatcgctggcacctgactaccctctggacctgagtttgggcccacccaagcagccaacactagccatgactcccacccacatggctgacaggcagagccattctccctctctccatggggtggcggcattaccacattggagaacaggcgagccatacaactgcctgcattgggctgagtgaagaatttccaccctgaagccactcctgcggagaggcacaggacaggcattttccacgtctctcagccacactgtggcctgcagatagaccacagtgtgcatctgaactgagacaccagccccagaacaggggtgtgatagggaagcagattgcattcctgcctatctagacgtggagccagtgcagccccctcatcccaccacagagacctctgtgcatgtcatcaggagctcccccagccacccctatcatggctggtgcctacgcttatcatttggggtatttgtgggaaagccagggttccagctctgcccagctgcaacctctcttccaccctcccaacctactcttagcaggaagctcagggaacctggcattctgctgtccagtccatcagctgaaacaatagagagcacctcagtgagcaaaggtcagatatacacccatgcgcttatgccacagccagtagttagtgagaatctctcaggcatcaaaatagtgagtaaatactaacacttcaaatagatcctttaagagagcatgctgaaattcaccagagacatgacaggaatcacagacagcagaggagagtaaagcctgcacagctgggacccccatggagcgaaaagaggttccctaacacagaagtgccccctactggcctgcaggttgaactgcacagcccaataaaaaacagaagtgcacagggctgcaggagaaaggccataacccctacagtgacaccctcaaggcggggggagggagagataacagagaaaatatcccacataaatgaaaataaatttgaacataagaagtgtcagctcctccagatgagaaggaaccagtgtaaaaattctagcaccatgaaagatctgaatgttgtgacaacatcaaataatcacactagctctccagcaatgagccccaacgaaaatgaaaaccccaaaattacagataaagaattaaatgtatggattgcagggaaggtaaatgagagccaagagaaagttgaaaactaacacaaagaaaccatgaaagcaaaccaggaaatgaaggaagagataaatacctttaaaacaacaacagaacttccggaaataaaaaatacacttaaagaatttcaaaatacagttaaaagctttaatgatccaagcagaagaaaaaattttcagatcttgaagactggtattttgttaacatagtcagacaaaaatatagaaaaatgaattttaaaaaagaacaaataaagatgggattttcaccaaacctataacttatagacattcctgagagaaaataagaaaaagtaagcaaagctggaaaacatatctgggggaataattcaggaaaatttccttaatctttctagagaggtagacttcaaaatataagaaactcagaatacacctataatttacagaatgggagaacatatttgcaaattatgcttccaacaaaggactaatatccagaatatataaggaagtcaaacaactaaacagaaaaaaccaaagaacttcatttaaaactgagcaaaggatatgaacactcatttctcaaaagaagaaatataagcagcaaacacatgaaaaaattctcaacatcaccaattattagaaaaaggcaaattaacaccacactgaaatatcatcttataccagtcagaatggctatttttaaaaagttaaaaaacaacagatgttggtgtggatgtagagaaaatgaaacattcatacactgatggtgggaatgtaaattaattaaatatctatggaaatcagcttggagatttttcaaagaactaaaaatagaactaccatgttactcagtaatccaactactgggtatctatccaaaggaaaagaaatcattatataaaaaaagacatctgtactcgtacatttaactcagcactattcacaatagcaaagtcatggaaccaatctaagtatccatcattggttggccagataaataaaatgtggtatatatacactatggaatattatgcagccataaaaaaggaaattatgttctttgcagcaacatggtggaggtggaggccattatccgaagcgaactaactcagaaacaaaaaatcaaatactgcatgttctcgcttataagtgggaactaaacaatatgtatacatcgacataaggatggaaataaggtgggaaataagagggtgggagggggatgagggctgaaagactgcctattggaaacaattttcagtatctgggtgatggctacgctagaagcccaatctccaccagtacacaatatatccttgaaacaaacatgcacatgtgccccctgaatctaaaatttaaaaaggcagcccacctgcaactcagtccacctgcatgaccaagggttgtgcccccttttctcccttcactagggtgaggagcttctgactgatgccaaaccagggagatcaactcagctggagtggaggaggcagggctggagtggcccacagaagggtggctggcaaagttccctctgcctgctcctactgtcactgttcaacacagaaagcctgggagggtccctgtgggtggccagggtggaggggttctcccctctgatgtcctctaagctcgccttcttaatctatgacttcctcccttgagggatgaggaaggatgacaggccctaacttgagttcacattggctaaactccaaaggctctcaatccccattaacaaacgtatgttgatttcaccaggatcacatacaactcttcatgaaattgcacatgcatttctccttatggggtctcagagccacagagatggaaagcagcatcttcatgtttacacatgggttaacacaggagcacaggccagctgcagagaagtgggcttgaacctcccagggcagaaacatagttgtcattaattagagacaacccaatctgaggaagagataaaatctctctacacttttaggttattttaattccctttctttttcctatctatctatatatctttttatttatttatttatttatttatttatttattttgagataggttctcactctgttgcccagtctggcgtgcagaggctagctgcaacctccacctactgggctcaatcaatcctcccacctcagcctcctgagtagctgggaccagaggcaggccatcatgcctggctaattttcatattttgggtagagacggggttttgctatgttgtccaagttggtcttgaactcctggactcaagcaatctgcctgccttggcctcccaaaggcctcccataagccaccatgcctgacttccctttctgcctaatgaaagcttccccacacttttcctggtgtcataagtataatgaacattttgtccctgagtcttgagagacacacagttccaggcaccttgtaaagttgcgttggctgctctggcacatttgtatgtggctgtaggcattaggcagctgggccaggcagtctagagccagagggtgcactgtctggctgtccatccatttccacacctgcacagacatgtgacccacctctctggaccctgcctatggggccgcacacaggccatgcacctgctggccaggcaccaggcacccttgtcataaatatctccacctgtccagcaatgaggtgggaacactcaattctttgtgaaaatctctgtatttacaataccagaagtgtgtgtattttgtgaaacaaaaactctctaaaaaacaaagcaagacaaaaaattgatgaagccaggcctcccattgcaggaagaatgttgagaagtgaagtgtggaggggtggcatgttctctttagcaccgacggttgctcagggaatgagcctcaaaatggagaaaaaccaaatgactgagtcccatccacccccagggctccagtgctctcctccatttcctcaacattgacctggcttatttctctggacgccttgtgcagggtgttgtgtgcctggaaaagcctctcataaccagcttgggagatagatgtgcagacacagaggggagaggctggggaagggtgggagaggcctgtttcccaacatcgcagctggcaggacccagatgcggagtccaggctgcggcaggacaggcgggtgcaagacggagaagggggacaagaaagagtaactcctcgggatgacggcattgaaggtcaaagtcatgcaacctagagaaagcccccaaagccctacacatataggcaagccattgtgttgaagcctaaaaaaaaaaacgaaacatggagcggggacattgccatccaaattagtcaatactgtttaaaacctaaacctgttatatttttaacttgtacttacctttcaaaaattctacggaaaagcataaatattgcattctagtagatgggggaggtggagagcagttgatttactctcaagatagattaggtatgactggacaacctcagccacagccccccaggtggtcccctcctcatgcgctcaggggccccatgtgaggtgcccttggcctgtgtgggtggcacctcgggctgtcctgtagccactgtctgcacacactggatggtaggatcctgcctgttgacactcatctctgttggggctgtgcttccttctttggggacaaatgactaagaggggaagtttatcttctgtaatgaaatgaggaaaatttgctgaagtttgcttggggggacagtgtggggtatctacaaagagaattcacattttccgaaagacactcattgccttctgggatacattcagaatttgagtagccaaaaaaatggaaagcagggacaagggtgtgaggagtataggaaataaaatacacaagtatttttcattgcaaaaaaagctagggagggtgatacagcattgaattcatatttcaaagactttgggggcttttttttagagaggaatttggcctaagacctcatggtcccaccctttggtgacagatgaagttggggctgttaggagtggaatgaatccatgtctggcatccccatggcaccagggtgctgtgttctggcaggtgcaatataaatccagctcattcagaggacaagctccctggtgacaaactctttggttgatcagcaagaattcaactcctttgaccataaacaaaggctcaatgtatatgtccagttcagcaacaaaggcctgttcatcttgggtgtttggtgccttagaagttgggctctaggggaggcagtgacaaagggggttctgcagtgtgcctgagaagagcagggagcagtggcaacatcctggagggaggcctcgggcacctagtggggaggaggtggcacctgggggagcaggtgatggggaggcactctcagctgggttgaaggcagctctttgcattgcagaatctgtgcttgggaaaagtactcccggctgtgtctcaggcacatccttgggctgcagggagcctgtggtagggaaaggcactcctggctgtgtggaaggcagatccttgggcagcagggaccctgtgtgcattgggactgtgcaagggctaagctgaggtaccttctccatagggaagagaagagagagaaggtcactgtgatggcattggaattgggctcagaaggctgcggttgcctggctcaaggggtggggccaggacccatcgagacccacagtgtgggccttgctgtgctcctcctctctcccctgggtgctgcctccagcctagactcctccttccagacctagctcaagtgtcgaatgtctcccctgcctctccaggcagccctgggtctctgactctggactccctcacttggggttgaacttgtcttcttctccctggtagccaggaggagcccccagttacctctgtaacccagcatggcctggaaggctctagtgagcatatggaagggatgagcactcaccacagccctcaaggctggctccagggacccttgggcgggtgacgagctgagaaggcagcagctccacggttcccttggtttgggaagaggatgatccagacccgtaggaacagctaattctgtcttgcaaaagcagttgctttgctttcatcctgggcacacaccggtgtagccaatccaccacccacacagctgcaagccacacagagattgtctttgtgttcgtctgcgatgccttcctctctgctggcttcttatgctcatgatcggggcaaccctgtctggagacttgatagggcctttcaaaaaggccctcagggtcactctaagtaaggtcaaagagactggggttcattcctgcctctaaccacaggcaagtcaatcagcctcttgggaatggcttttccatctctcaaatgggtccagcaatactaaacacggattggtcaccccaagtccattcttcctgtcttccttactaacgaagcctgcttttgttaagagaggaaacgtactcagctgtaaaatgaccttttcctggtctcccttgctgagcagcatagccatgtgaatgcactctggcaatggagtataaataggaattgttgggcattgctttaaagaaggctgctttccctttttccttcttctttctgcctggagtatgagtgtgatggctggagctccagaagccatcttgtaagcatgaaagcaagttgaaagcctggccttttcaaagagaattgttaggtttccccaaggctgttctcttgggggcttagcaggcagcgaattagataacaatctttctcagagcccctcagctttccatttcttaatttgcctaagctgtcctctgtttctggaatgctcttcctaaccttgtctgcccagtgaactgctgctcaccttttcagactcagctccagagtggcctcctccaggaagccccttatccttgctcccagctaaagtaccacccttcttggtctttctggtcatctcctggctgaaggctgagcctgttgtgggaaatgccatgtccttgtagatgtgcctgtccctgctctgcaagcatgaggactgtaactgcatccccttcagcacctgtggctggagggctgcagcaggctcccagaatgccagtgggcatatgccactttgcctcgacctccccatctgtgatgtggtgctgatgatgcccacagaccacagcagaggcagcagcccatcaatgcttgtggtttccctggcatggggcctgttcagctccttctgtactcaaggccacccttcccaggctgcctggaatcccaggggtctcctgccaggccagtctcagcctgatggtcccaaggaaaccctctattcctcacaggtgttccccagagcatgcagactttgagcttgcttgaacctgtcattcatgcagaaagcctccccttgggcatgtgagtggcaaatgcctcaaatgctggattcccttacggagacggtctctctcttactgagagggacccttctcccctctaggccccgtcctgggatctgccctctcctgcccctgccctgctagtccccatccaggatgatgctgactttccccttgtgccccctcagaccctgtcctgagccacctgtgtctacagctgcctgtccaccctcctccatgcccgattgggctcctgccaccttttcagggattcaggcttccttcttagtacaacccaagtgtgtcagcctgctctccctggctccacccatttagtcctcccaggaccatcttccctcccagctcacaccctccagagaagctctacactgctggcagaatccagtccctccacccagcctgcatgtcagaccgtccctgccaggctcctggggtctccacaccctgccttcaggcaatcagagcccagctacaagaagaactggccatgccctggcaccttccctcgctcctctgccttgagggctctgttcctctgccttaagggctctgctcctcacctctccatgttgcacatccaagcccagccatcatgtgcctcagcctcagctctgatgctgcctctgacaagctgacttccctgaaggggagcaccctggtcccaaagccccagagcactagagctgagcctctttctctttctccagacagcctctctctctccttgcagcacagagttggggactccttcccatcatgaaaccctcaacttccctgccccaggtcacacaccaagttcaaggctgagcacagagcaaaagcaaccagagagtccatgggcttggcccagacctcagcctggaggcacagggacaatttctctccacttctcctttgagcccaagaagtctcagcaccatattccatctgccactgccccctgaccacaggccaactggacccagaacacaggacacttcatcaggatgtctgggccacagtcccggcctcacagaggtggctcgtcaggggggctcaaagccccacctcactcttcctggcaccatccagactataaggcccagacaagatctcacctgctgttcagtgctctcttctgtccacccaggcctcagcttcaaccctcttgcctctgagcaatccctgtgtgcagtgaggccattgtgttcaaaccttcttctggcatggttaggaggcatagtgggaaccagaaaggataatgccactcccagaaggagatgggccctcctcctggcactgccaacccagcctgggggatctgtgctgacattgtgaggggctgcctgtgctagtttttgtgggaggggaggtgccagctatggggttccagggtgccgggggcctgctgactgccgaccactcatttctccctgccgtatatcaattttgacaccagtgctgaagtcctcccagggacattccaacttcagaccctgtactgtcttccttccttctcctaatgtttgtctttctttatttccagagctcctctttctttttctaagctaggcgctttacacacctattcttctttacttctcagagtaaagccctgcagaaacactgagacacaaataatgggtgatcaatgcttttcctgggttgggggctaagatggtcatctttccaggtgtgaggagagagggtgaggcaaggtggggacacagcgggccacctcctctccacaacaggatgagagataaagggtaggttcccctctcagtattctccctgtcaagcactaagaggagtctggcatgcatttgcacaggaggttcttagatgtgctggtgctctcctagtgtcccggacagctgatgagccagaactgtccacatccatcctgatgctggagtgggcaactgccaccaggtgcagaccactggcagacaggcctggattggatctggctatacaggctcaccttgccattcccttagccttgccatagcatagcctagcattctttatgtctccatttcattttatccttatttttgagacaagaaagatgaaagttggagaagctaaaccactctgagccatgttcttctatgattacccttggaaatgccaaaggggtttctcacttctccacagttaggcccaaaacagattcctgttcatacatgtcatatctgaaatgtttccttgtgaagcagaaaaacaaccaaaagtatattcaaaggaccgtgtctcactagaaatactcattcattcattcaacagagagccctgtatctgtgaacccagatgcaagacaacaactacttgtggaaaacatactcctgtcaacactgacctgcagggctggtgcgtgcctgtcttccacaccctgcatccgtgtgacactgactatcatcatgaacagattgacaaggacaatatttgatttcctacctttggttcaccaactccaagctgccccaaaatattcacactggctgtatcttctgcttgaaaggaatcccccagatttttactccactgacttcttatcattttttctcagtttaactgtcactccctccctcttcctctccttttctcccaaaagagtcttctctggccaaccaggcatttgttgacacattaatgactttcaatcctttggacagtatctgtcaccatatgactctccctaagaaaatgtaaacctgccatgaaagtgagacattcttcatctggttcattttgtcatcccagcacctgatgtggaatacatttttgctgaattaatgaatatgaataaatctgtgaatattttcctttgaacatttttccttgtgacaaagctggtcttgaaattaaagaaaaaataaaaaaatttccactgcttttatgcttatctagacctctagaataaggattcatggataatgaaatcaaacttgtatttattctagttattattagtaattatatatgtgtatatatataatctcatatatatttaaattattttgtatatattttagtgtattatgaaatcaggcttttatttgagcttttccccaatagcttgccaaagtttacaaaaacatttgtgttaaatcaaactaaatttgacctaagaaaacctctgtaattgcatacttgagttctcacacatgaactgcaacctaacaaactgaaaccctaaatgagaagtctgcttctgtaacaatagctgagtcttagccaatcacagcagccatgcttcaaccactcataaggagccaattgttcaaaccatgttcaaataaggcaaatgccaaggtgtaactaatccagatgtttgtacttcactttcattttctgtatgtcatttctttttctgaccatacatcatatctgaccatatggtagccacagaccctctctgaatctgttctgattctgatgttgtctgagacacatttttttcttgatcagttaaactctgttacatttaatttgtttaaatttttcttttgacagatttggtgtcagaagataagtaaaactgcaaaaggctggagaggcttcaagatggctgactagaggcatcaagaactcacctcctccacaaagaaaaataaaaatagcaagtaatcacacttcaagaagaacatctaagagtgaacgctggaattcaatagataaatgatgggaaataactgaggcatgaaaatggaagaaagtgaggcagcaagcttggctgggattggctgggaacccagagtggctccctagtgcaagaaaaaggttagtgagagatccacagcggttgacattctgaccatggattttataaccatagccaaaggaaaacccctcaaccctcataggccctgagactagcgtaggaaggtgcctagagaccatgtaacagcactgcttcagagggagctcatgtgggtcccagtccccaggtcttaggcagctgtagctctctgccatttggagagcccagccaccaccagactgcatcctgcactggaaaccaacagcccctgcatttccacatctctagagtcccactgacatctccctgtgttcacctgtagggcttcagtagtgcaatgccagttggacccagcagagcctccctagcactctagcacacacagtgtcctgcatcttggggaatggacagtgcagcacaatagggaggctgcctccccagtgtgctgagaggctgccctcagagaaaaaggagccaaagtgtgggtttcttagagcttgaaaactgtctacctggggcagttatcatggacagcaaccctgttcccaccccagcagtaaggctgccatgcacatgccttgagggcagggtctgctactgctcactgcatctgttgttgctgtcactggggccaaagcacatgccacttgacagtgactttgccctttttgggcagcagagccacgcatacttgcatcccctttactactggttttccctgttgctgctgctaccactgctgctgccacccctcaacagctaggggctgaatctcacacttcccagatcctgagaactcctgcctatggctggagccactgtaagcaacctgcctatggcccagccatttgcacataccctgaggacagtttcccctggcccactgctgccactgccacagccacttgagcactctgccagtgggcctggggacccctccattttgccaaccacagccatcacctgagtgttccattgaggggcctgaggatacacccacccaccttgacactgcttacctcagtgcccaagcacactgcctgggggcctagggattacccccactctgttcaccattgctggcctctatgtactcctcctaggggcctgatgatggacccactcagtctaccactaccaccacagccagcatccatttgcatgtaccactttgggtttagggaactggcctacccagccatcactaacactgatgtgtgttgcttcagagccttagagttgctgtgttgttgctattgtcaacactcactccacacatgctgccaagggaaggacctgcccgctggccaggcctaccactatgactgccagcacccaagccagccacatggaggcctaagaactggcccatttgtacctgctgacactagtgcctgtgtacactgcctggggtcacaaggagaggtacatttaccctgccactgccaccatcagggtttgagggcacacccacctaacatccccaaccgcagcaaaacatcatcatagcctccactaacaaccacagcctaagccactagggaaatcacacaccactgatactgcttagaggtgaagaaatcatagagacactacattacttcatacacttagaagcaaagctaaagtgtcctacccaataaaaaccatggaaatatcttcaggaaaaagccaatccaaaatgtatgaagaagcaactgttacaaaagatgtgcagatatcaatgtaaaacgcaagaaacatgactaaacaaggaaatatgacacttccaaaagattacaataattctttagcaacagatttcactggaaaaaaaatttatgaaacgtgggaaaaataatttttaaaaatgatattataaaagctcagtaagacacaagaggacataaacaatacaaaaagttagaaatcaactgaggatatgaatgaaaaattcaccagagaaacagatataatagaaaaaagaatcaaacagaaattctgaaagtgaagaattcaatgaacaaaataaaaatttattcaagagcttccacagtagagtggagcaaaaagaagaaagcatctcagaacttgaaggcagaccttttgaaataacccagccagagcccccgtccccatgccctactcacacaaaagaataaaaaacaatgaactaaacttacagaacatacgggacactataaagcaaccaaaaacagaaatttggggtgttccaaatggtgaagagacccaaggtatagaaaacctgattaacaaaataatagctgaaaacttcccaaatttagtaagagatttaacattcagatacaagaagtttagaaattcacaggtaattaaaaactcaaaaggtcttttccacagcacattatagtaaactgtcaaaagtcaaacagagaattctaaaaagagtaagagaaaggaaaaagctctggtcacatatataggaagcccgatcagaagaacagttaatttctcagcagtaaccttataggccaggagagaatgggataatacaggagagaatgggataatatatttcccccctaaaaagggggccaaaaaacctgtcagccaataatactatacctaacaacattattctttatctttaaaaaatgtgaaataaagttttttccacacaagcaaaacctgagggaattcatcatcactagaccagccttagaagaaatacttaagggagtcctatgcctggaagtgaatgaatgatagctaccgtcatgaaaacatacaaaagtctaaaacttgctggtagagtaaacacagaaataagaaaaagaactcaaatgttaccactatagaaaaccagcacaccataatgataaactacaagagagaaagaaaggaaaaatatacaaaacaatcagaaaacatttaacaaaatgacagaaataagtcttcatatatcaataataaccttgaatgtaaatggattaaattttccacttaaaagataaaatctggctgaatgaattttgaaaatgccccaactatatgctgcatacaagaaactcacttcacatgtaaacacatgtagactaaaaggaaaggaatgaaaaaagatatatcacacaaatagaaaccaaaagtgagtagaagtagctatacttatatcagataaaacagactttaagacaaaagcattaaaaagtgacaaagaaggtcatattatataatgataaagggatcaattcagcaagaaaatacaacaattctaaagatatatgcacccaacaccagagcccccatatacataatgcaaatattattaaatctaatagacttcaatacagtaatttttggggacttcaacagttcactctcaccattagacatgtcatccacaaagaaaaccaacaaggaaaaaataaatttaacctacagcttagaacaaatggacctaggagacatctacagaatatttcatccaacaactgcagaatacatgttcttctaatcagcaaatagaacattatccaagatagaccatatgtcaggtcacaaaacaaatctcaataaatttttaaaatatcaaaatcataccaaatatcttctcagaccatcatggaataaagctagaaatgaataacaagaggaacttggaaaatgtacaagtacatggaaattaatcaatgtgattctgaacaaccattgtgtcaatgaggaaattaaaaaggaaatcaaaacatttgttgaagcaaatgaaaatggaaacacaacatacccaaacatatggtatacagcaaaagcaatgcctaagagagaagtttgtagcaataaagacctacgtcaaagaagtagaaacaattcaagtaagcaatctaatgacgtacttcaaggaattagaaaagcaagagcaaaccaaacccaaaattagtgtaaggaaagaaacaatgaagatcagatcagagtaaaactaaatgaaattggctaaaaatacaaagaatcaatgaaaagcaaagttggttttttggaaagataaaatggataaactgctagataggctacccaagaaaaaaagagataagacccaaataaacaaaatcagaaatgaaaaaggagacatagtaactaatactacagaaatacaaaacacatcaaaaactattgtgaacaactatttaccaaaaaactggaaaacctatagaaaatggataaattcctggacacttacaacctaccaagattgaaactagaagaatcagaaaacgcgaacagaccaataatgagtacaagattgaatcagtaatgtgaaaatttaccaacaaagaaaagcccaggactgtatggcttcactgccaaattctaccaaacttatgaagaagaactaatgtaaattctcctcaagttattctaaaaaatagaagaggcctcattctatgaggccagcattattctgataccaaaaccaaacaagaacgcaccaaaaaaggaaaactacaagccaataaccctgatgaacatagacacaaaatatcctcaacaaaatactagcaaattgagtgaaacagcacatcaaaaagataatcccgccatgatcaagtgggatttactctggggatgcaaggatgatttaacgtacacaaatcaataaacatgatatatcacatcaacagaatgaaggacaaaaaccatatgatcatctcaacagatgcagaaaaagtatttgataaaataaaaaaaagctttttgacaaaaactcttgacaaattaggcataataacggcctcatatgacaaactcacagctaacatcatatgaaatggggaaaagctgaaagctttccctctaagaagtggaacaaggcagggatgcccactttcaccactcctattcaaaatagtactggatatcttagccagagcaatcaggcaagtgaaagaaataaaaggcatccaaactggaagagaggaagtcaaattttccctcttggcaaatgacatgattttatacttagaaaaacctaaagactccaccaaaaaacttctagatctgacaaacaaattcagtaaagttgcaggatacaaaatcaacatagagtctgggtgcagtggctcacatatgtaatcccagcattttggtggaaggattgcttgagcccaggatttcgagaccagcctggacaacatagtgagatgctcatctttattataatttaaaaaaattgttaaatcaacatacaaaattcagtagcaccaataataacagctggaaaagaaatcaaaaaggcaatcccattaacaataactacaaaagaaatacctagaaataaatttatccaaggaggtgaaagatctcaacaaggaaaactataaaacactgatgaaagaaattgaagaggacacaaacaaatggaaagacatcccatttacacaaactggttgagttaatattgctaaagtgattgtactacccaaagccatctgcagattcgatgcaattactaaaaaaaataccaatgccatttttcacacaccaactccacacagacagtgacctcagccgggaatggatttttttctgatcagcatcgtcatttctcactcagtgttcagatgacgttgaatgaaatgacgttattcaaggacctgctgtgtgacattttgcactgtagagagatgcacttgcaggtgtttccatagatcactctgacagcaggatatggggcggaacctgactcagacatgagcctcccctcaggtcagttcatagcccggctctaccactcaacaaccctgccacgttgagcctatcactaaacatcagagcctcggtgtccacagctgcgaaatgtagacagtagtgactaccttgcaggacagagaggtggccatgcacacagtaaggacctggagccaggctgttggatgctggtcctattgcttcctggctgtgtgaccctgggtaggttacctaactttctagggcctctagcttcctccccacaatagagttatggcatatattagtttgtggaatgtagttgcaacagtgtctggcccaccttaagatctatatgaatggcagctatgagccttcctgggtgttgtgagaatgaaatgagatccagtttctaaagggcctcctgctgtggtgcgcacacgaattaaactcactggaaaggctgttatatcattgtgggcactatatttggtgacagagagtaaggtttcacactattagcctgactttcctgatggatcgagtaatattgtttcccattaacataatgagcatccacaggataaggtgaaggagaatcctcagcatggatgggaggtagagtctggctcaagagcctctgaatcttgctgcttcattttgtatgagtgtgtagtggggatggcctggaagaggacactatcaaaaaatttattcagggaactgaaggtgatggagcagggagacacactcaatttaaaacaaaaaaaaattgaaattaaacaagactgactgcttttgccacaaaaatgctgaggtttttggtaaactgagccttggagaatttcctgcattattatgtgctgaaatgcaaaatgtttggatttgctgaaacaataaactaaacaaggttttaaaaggcagcagctcctctaaattcgacagcacactccagtcgaagaggctcaacttcccgagcttatcacacccccaggtcagcccacaatgccaagtcaggaagaggagtttggaaatagcctcctcacaaggccgggcatggatggagaaagaggcatgcactggttctgtcaggatcccccaacctgctgagggcctgagtgaatccctgtctgaggggagatcctggaagaggggtgtgcagcacacaggtggcctcttcactctgcagtgaagagacagacagcctatgcctgtcctggcaggacgtctcactgatgcctccacagccctgcagttgcagttgggctgcctggctggggccgagccacccatccaagcctggtctccagcgggttctcactgagatgcactctctctcctccagcctcagggctccttctcactcagggaacccctggctcaggcaggaaggtcacattcccagtgtctccaagcagaaagctgctgagctcaccagcagcctggctggtgtctggctctgtacactcatgactaggcttacagtctgaccctgtggctctgaaatgggctgaaggtctcagggggacgcgtcctctttagtgtatgattcacgttagaccctggggccagcacaccaaaggcttaaagaggagaacaggaattcctgtcagcctgtctgaattcttgggtacccgacagaaatcctacaagacactcagtcgggtgttcacgactacagttgggaaggacaaggtcaaattagattgtggcagaggagctagaagggagcccaggtctacaagccacagctatgggcctccctgggttagggacagatctggggttgatttctgatagccctggagacagccacttgtggccttgggcaactttctgggccactctgggcctctattttgccattagtaaaatacagattgtctctcctgctggagaatttcagggtgaacttcacacagtgacagcggaaagggcctggcagagccctgggcagtgtaattgccctccttaatacaattactctgccaccctcccccaaactttagctgcttttgggaatgggacaatttcagagacttgctccatcccctatctcaccacactgggcagtaaggccatttctggccctttcccatgcccaccctcccgtctcttgccttccctctgcttgaggtgcccgttttcacaccccacagtcgagctctgtcccttctgactgagcctctcgctgttcagtgcataaatctggactaggctgtggactggaactgggctgtggcaacgtggagaggccttatgggacctcagatggaaagtgggcttctgtgcaagcgtggctgggattgagagccctgtgcagaggcacagagccaggaacccagcagctggagcagccctgcctgcctctgacaccagcaatgccctgccaggtgtcagcacgcctcccagggcctcccggcccgtttcttatcagcagcgtccagaggcttgcagcctgcaaggccttctcagtgcgcagccacctggccactgagagcgtatgctgacctgatgcaggaggtctggccagtgcaggtccctctataaaccctggggatgagatcatcttccaggtgtaaaaggctggactgtgggaggcacagggagatgagccccaggcccagccagtagcagggctctccagggacccagggcctgagcagagaagccccttggtgctgatccgaaaggagagcagtgcagagtaagggcaggagccaggcccagggcacatccagccctatcactcgcgggctttaggagcaaggacatgccacttaatatctcagcgcttcaggccccttcagtaaactggataataatagcacgtaggtacagttactgggaggatgaaaacagtgaaagcatggcctaggctagcaactggcccacagaggactctgtatattactgaggcctcgttagtaattattagtcctcattcataataagttacaaagagaaaatcttaacaatttcgtcctccccatggtcccaaggcaatgatacaggaaggaatccttattccctgttagaaccaatgttgccccgacaacgctgtcagccatcccaaccagcacttctgaccccaggggaccagcaaaggaagcacatagtcccaagtccagaaacgggctgggaggcccatgggcaccgtttctgtgtgtcttgtgccgtcctctttggcagacgcctgacatggctctctgagccacaatcccagaggacagcagtcagggaaaaagcagtggccttctgtccatcaagtgtgtccctgtgccccagctcacctggcccctgtgctgacaccacatccatggcacctggcagcagcttgggtgagagaggtcacggaagatatccagattgccctgaaaagcaacgtggccatgatgaagccatgcagcctggatgccttctcaggaccccccggcccgccatggctctatcccaaggaacacacgcagacaaagctcccatttccccctgggggaggggcctggcagggttgcatgttggagacatggtcactgtggccacagagagttttggaatctggacaaaaaagtattttggttgtaggaagaagaaaagccaggggcagattcatacaaaaagtccaaaggcgggaggagcctgtggttccaagcagaggtcctgaaggggagcatgagttaggcctgggggcccagcatgggggcctgggcagggagaaggagccttgctgctggggcacacaaggggaaggcaggtgagaggaccatgccctgctcagggagtaggtacctgacaccagggaagagagaagaggaaggcagagaaaaacaggccagaaagcagcccaggacccacggcgggcagccccttggccactcggcgctgcagtcaggcctttctgggctccggtggggatgggatgagggccgtgtgttgcaaggcagtgcaggccgctggcaggtgacttcctccccctggagacatgtgccccacactctgaggagagacaggcctggcttccccagatgcccactgaggctgcagaggagcctgaccctcccaggaggaagcaagagatccgaccacagacagagccaggaccaagggggagaggggcagagccaggtaggaactctggggtccttctccctcaacatcagccacccaggcgccctctctacccctgtgcagggccccctgctgctgcctggctgggttcccctcagcaagatgggccctggacccgcccatgaaggaggtttcctcagggagagtggctgttgtgttggctccggggctcaagctcctgcacaggtgtcttgtgagggcgctttcaggcctccacctcctcccctccctgcagcacctgtcagcccattacagcaggcgacaagcccactcagtgacagcttttcctcactgcctgaagatcctgctgcccgggctggcaggtgcccctggcatccttgcagtgttcgtggtggtgagaacgtgtgtcaggactggtcatttctatttttttttctttctgatctgcatgaccttttgtgactcaggttgcctgacccatgcacctgcaggcaggtggtctaaagcccagggccattgccagagctgaggcacccctgtggaaaccagggactggtcagacatcagaagctgccactgtacagaaacatggatccttctagagagggagttcaatgtgtggggacagacctggtggtgcagaggacaggagccctcatatatgcctgccactggggcacgaggctgaggtggccatctggttgctcttggcatcacgtgtctaaagtccagcccctgtagagcctgccttcctccagggcccaggtctccacagtgggacccatctgccccctcctcccacagttccaggctgggggtcgcagcccctctccactgtgcttctcacctctatccttctcatccagaacactccttgacacctacagcaacaaacaatcacagtggggcaggtgtttacaggagccgggggcagaggcagtggaggcagagtttgtggtggtggagatgatggtatctcctgctctagctcctaaaaaacaatggtctgctgacttttcagacaactcttaagagcaagggtatggtgtcattgcctcagccagcaccgggcacagtgccggccactcccagatgtgtgtctggggaatgaaaggaccagtaagaagcccacaccacaggggaccatccttcacgtgagaaaaaagcaaactcctcctggtttgcagacatggctcttcccctaaatgctaacaacttcatcccggtcgccttggttctcccaaggccagccttgttggaggaggcctgccctgggagctgtgcaatggtcccagcatttgcaggtgactgtccgcatccacctggttgcagatgcagcctccctgggcccactctgcagcacctcagaggccacccttggccagggaggcctgttcccaccccatcccaggctcagggcctcctacctcagctactcaccactgcctatggcccctggtgtgggtccccagcccaggtgagccacagcctgctccccgactcctggcccctgtgttcactgggctggtgtccctcccagctgggtgctcgccaggcctccttcacccctcagccctgcagtccctagaagctaaccccagccagacccttgtccctgccaggaaacagggatccagagaggccaaatggagccacacctgcatccggagcctggggatggggctaagctctgtcctctccaccctctgctctgtcctctgtctgcagctctccgggctggcttcttccaccccagcttccagcacccctgacactctccccgccccagcctccatctctgcttttggctcctgctctgccttacagggggcccttcccacttctgtggggtggacatttcagcctcagccacaacaagccaggactgtgagctgcctgtggggagcttcatttctgtccctcaccagcccagcatggggcccaggggaagctggagctcagtaaagacagatgaaggaatggggaaggcaccagacatgtgctgagatccatgctggttcctcaaggcacagacagctgggggttacagcactgtcctccatttgggccctcaggacctcatgggggcccctctcttcctccctccacacaaaggctgcctcctggcccttgtccatctgtggcttccagaagtccggattgttgaggcagccctggtttcaggggttctggggtcacttctctctaggagccagggcaggcttcagccccatgtccaggacatcccaggccagctctctgtggccagcccggggcaggaggccctgcagaagcccaggtttgctaggctctgggaatgtgtggacaggtctgcgactccccgggctcatgtgatgagctgggagctgagggaaacttcccacaggcgggatcatggggcagtcacatgttagagtccctcagagggtgggcctgtgcctgggccccagagctgggtgggcaaaaatcacttgccttcttgcggcacagccaccaaacacaacacagcagcagtggcgcaagcagcaggggcggcacaaaatagagccagttgcaaaaaatgccctggctgagaaagacagcaatatgaaccacgcctaagggacagaggaatgccaggcctgggagggcctgggtagcctcatcctggtgcccaccacttggaggcccatctgcccattctcccttctctacaggtggtcccacctcaaggcacaacagtggggccgggggtaagggatgcttccaagggaactacaaacccctcctctggccccgctgaaagtctctgcccaagagccctgccaagaaagtcccggaagcttccactgtctgacaaacccaccctcactgcacacctcgcctgcagcacagggcttctgtgaggaccacaaaatctccaggtacaatgatgggcaagggtgggggtgctgcagccaagagaggtgcaggcgcaggagcaaggacaggagacccgggtccatccccacagcctctatccccaattccaggctctgcaccgtgggcacatccacacagagctctgagcctcagcctccacacctctgcaaagagaacgggcctccctccctgggggcacttgtgaggtttagagagctcagagaaagacctggctcagaaccagggccacatggggtgtaagcaaccagaactcttctctgggtgttcttcacagtaaagggaacgtgggcagcatccgtgggaatacaggctgcccaggccttccccaaatccagagttctgtttagagagaaagatggggaaggcaggggagggcagggaggggaggggaggggaagggaaggcaggagaggggaagggaagggaggggaggggaggggagaagaaaggaggggagaggaggggagggggcctgtgctgagaacctggctggctgaaggagaggaaccaccgaggctgagcatgaaggccgccggtgaggctggagccccagggctgctcctgatgtgcctgtcactgtggagccgttagtgggtggattcctgatggggaatgtgtgcgttcagcctgctaatccatgcgtggatatgcagggacaggcaggggtagacccagagggaggactgtcaacactggtgcgtcctcacaaataagactggacacaaggtggtggagtgggctcaggcctcccgcctgtccctccagcacatcctcctccctatgcggccctgggccacgctgcccaaagatgtggagctctgaaaagcaggcactgggggcacagcacttccattctcaggggcctctcggagctgagcccgggtcccagtgcccagagcctccccttcagcagcaggaggggacgaaatgcaggacctggtgagggagcagggagggacatctcaggggcccgagcaaggaggagaggcagaaaggaggttcaaggcatctgggcaatgacagcaggttacaaccaggcaggctcaggggccagggtcatgagcaggttcaggaccagatcagcagctggggcaccagttcagtggcacacgcaccctgatggcagtgtgtggaatcctccagagctcctgggcctgggaggtccacgtggagaaggtggacacccaagaggtactggactctaagctcctggcagacagcctcccagcttcaaccacctgtgccagctggaagccgggttggagcagcctcaggtgcctgctgcacacgctactttctgggactgcctggaaactgtctgccctttctgtgctccccagggtgtatctccttctagtgcagggactctggacagtcctcatacgtgtttgcagccccatgctggtactcacacatgtggtgctggtgatgctgacattgctcttgaatgttttgccgttgttcaagctgacttcaatgaagtactccctaaagcacagaaaacacagacggtgagagccagcccagagagatgcagttcttgaccttggccagtggacagcgtgggtaatgagaggtcattccccaaacgcttgcaggtaaactcagcaatgatgaccaaagggtaagtgggtcaggcagcgaggggccctgcatggggtctcatgccattgtgaccgtgtcctaaatgaccagggaccactgcttggtgtcaccatcccagctgttctgtatttacagagtctgttggcttaactctgagaagcaacctggagcaaaggtaccattcctcaggcaatcatctcctgcatcctgtcctcctcacagaccctaggatgctgcagatccctgaataccttgggggcggccaccaacaatagaaggtggagagggtgcccttaacccagtggcagacacgtgccgccccagcagtgggggtggcatccacattctgtacagctcacagtgcccaaccctgaccccctggcctcctaacctatagggcctcctgccaggtttttctatctttggtccagggcaagttttggaagtcttgtccatactgattggatgttcatctaaaaggaaatgacatgggaagaatgtcgatgcacttgtctgaccagtgtctctccccatgtctgtcctcagcatgcagagctgaccctgaggcccaggaccagcatctgggctctgccttcctcttacagagacccctgtgagcacccaccatacccaggccctgtgcaatgctctgctgtgtaacaggaacaggcaggcagagtccctgctctcaagggactcacatttagagattgcatgggacacagaaaacaaaattaaaaaacaaacaaaaaaaaaaccaggacagaacagatgacagagagtgcaacgtgctgtgatgtccatgaccagaggaggtgaggggaccagaggggcagggacagccacttcattatgtgtgacttctcctatcttgtagagccacaatttctggtctagaggaacatgaaataatgcaaggccagggatttgcttcaaaatactctgtggtaagggttccaaggaaagcagatgggggcaggttgagaattattgaaagtaggtttatggcacaattcttgttattttgtatactgttgaaaacttccatgaataataaattctctctgaaaaggtgacatttcagctgaaattaaaaagatgaggagccagccaggcaaagatcatgtgccaatgccctgggcagtgactcgctgaccttgtcaaggagggaaagaggtgatccagaacagggggcagggcctcgtgggccctggaaaggggttggggttttatttcttgtgcagtgaatctgtccaggttgggcagatccaggatgtattttgcacatggaggcaacaggacttgctggtgggatggatgtgaggaagaagctcagaggagtcaaagatgacatttgagtgtttgaccagaataaccgggtggacagtgacaccatttaccaaaagggggaagcctgaggaggtaactgggtttgtttgttttaagtctgtaattttgtttcccaatttttatttctttatatatttatttatttattttttgtgggagtgtggtgggctcaggagagttctgtaacatgtagacatagaaccttctcatcctgagcccacatccttttcatgcctcctgaagtgttggggagggcacgggccctgctgcatctgcctgctggcctggctccagctctctacccactgggcttggctgccaggaccccggcttcccagggccagcaactgcctggccaacctaggactgccagaacccgtggtatcgacgttttcgccaaggatgatttcaaaacaattatggcatcttcctcattttcctttgaaaacctttctctgcttttttttcacctccctaaatatgcacatagtttactctggcatgtgttttccatgccttattcctgaataaatagcacttcagtctctgtttgttattttggttgataaaaatcgtatccaggcacttcccagaagccagaactaggctctgcccctgcttccccatagggacatatgcaggacagagggaagtctctccctgacctgcacctccggtctggcatcagccaccagggaaggcacgctgccatctagtggggggtgcaggggagacgtgttcagtggtggccaacactccagggacatgttccggggatatcttcctaatagtgaaaataggtttaaaggttgttctcaattattttaaaaaataagcttccttttactcctggataagccatcaaccaggagcagaatggccatctacgcaggtgctcacagctgtggcatgggctccccactgtgagacgtcggtgctggcctgtgtatggagaggtagatggtaacctccagggtgggaagccagtacacccacaggcccacagaggaagcagctgaatgcccttcacggaggtaggctgggtaccccctttcccaggagctgccaccacagggaggcagaaggccctggtagggcaggaagattgcctgggtctgctttcctgccctgcaacatgaactgtatggccctgggcaggctcttccatcatgcttctctctagttctccatccatacgggaaagttgtcagaactaaaatggagtcatttgtgttaaaaaaataaaataaagtccatgacagttagggctaagaaaggctacaaagagagggttttatgcctatatgcctgataacaaaaatatcacaaaagactttgcaaaaaccacaaccttgcacaaaagccattgcagacttaacacaaaaaaatacttctacaggaacatgtgcccaagaactgcctgtccagccttggactagtgtcacccttgtaactgatctttttaggcaagagtaatggtctcaaaacaattccctaatcttcatttctcctttaaaagcctttgtcttctttacctccctgattatgcacattactatggcacacatattcccagtgccgggcaccgttcctgaataaatactgttttcttttagagagaaactctctgtcgttcaggttgacataaatggtgtccagaagtaggacctggagtaggaccactacttgaagaaatcagccactcttggaattggtgtgcagtcctcacttgagcccttggagctccctgtttctgtgacttgctttctctgccctggagagtcttctctcaggctgagcctcctacttttgggtggaagctcttgacttcattcagcatctgatttggataaggccaccgtaagccaaagagcttacatccctcctgaaatgataacaattttttgtcttttccagtaattctttctggtataatgacaaatgtttttctgatttgagcaccctagtttctacataatttacatttgtttgtgaggcatgtcttttctggcaaattcacttttagttctgcatgcctaattaaatatttgtttgatctgtatacccgggttaaaatatctgtgaacaatgacattggtttggttccatgtgtctgtaagtcatatggaaccaaaaaagcccacacagccaaagcaagactaagcaaaaagaacaaatctggaggcatcacattacccaacttcaaactattcacatggctatagtcaccaaaatagcatggtactgttataaaaacaggcacatagaccaatggaacagaatagagaatccagaaataaacacaaatacttacagccaactgatctttgacaaagcaaacgaaagcataaagtggagaaaggacaccctattcaacaaatggtgctgggataattggcaagccaccatgtagaagaataaaactggttcctcatctctcaacttatacaaaaatcaattcaagatgaatcaaagacttaaatctaagacctgagactataaaaattctagaagataacatcagaaaaactcttctagacactggcttaggcagacacttcatgaccaagaacccaaaagcaaatgcaacaaaaacaaaaatatttgtgggggggtaaattgatgaaaaaaattttgcatgtaattgacttggtaataatcagaataaaattatttataagtcttcataaagattgagctctgatattaaaaatacagtaatactaaactaaaaaattggtctcctatattagaacaccaaagttttcttgaaatattgatttgctattagtaaaattgcaagaggttttgatttttaattctgactgctgttttctttaacagccatcttctaaactgcaggcagtttctattcctggcacattttttcctgagatccatttaatttccccagtttcagataaggaatgcaatctttttcatgaagaatggtaattttattcattaaggtataaaatttatttatttattaaatagaaagtaattttatttatcataaggtaaataaataaatggtatttatttaataaggtatttattttcctcaggttcttatttcagaagttcaatttctgctgcatcccactgcacatggtctgcaggccatacaccatagcctgtagcgctcctactcccttcctccgaaaagttacagctttttggttggctgaggtgataactctcttctccaactttttcatcagctgctccaacttttttcctccagttctaacttggcttttatggcctggcactataatgtttatcttgaaggccaagaaaagcaatgttttccgccaatataactagattatgtactcttggcttttcttgatatgtctgaattgttccatgttaccaagaaacttcacgtggttttactttatctaagagctctacattcctctgctcaaggtactagtcttcttgtttatactctcctataatatgagtgtacattcataacacttggatatgttcttttatctctaattgaatttaaggaccctttcatcaggttcaattccaagactgaacaggcttcccatgagaagaagcaattacattgcaggagattttttttaccttttggtaactgacctaaaagacaaacaatttatatatttatattttaccaagataattttctgtgttgtctttatcaaatttttgattacttaagaaaactgagctttgaacaggttaaggttttaaaatatttgtaactttctgtattgcttttgaagtttcctgataatcactcgagttaaatgaatggctattatttaacagtgacctgtgattctattttgatctatggctttgaatctcttgatatttttggtgggcttctcctggatcaaaattctaaattaagtccttttgaactacaattaattttgagattttccagttgggcccttggagaatatgcaagaagatatattttaatttatagaggtattaaatgattaggcttatttggtaaattatatgacaagcattgtcaaatgagaagtgaggctacatcttcttttagtcacatttatgggtaggttattgataggaatgttctaaaaattatatgacaaaatctaatatattataagtcataattttggttgttatgttaaaacttctttaaagttgtatttatttggctgtgttattgatgtgagtattctaaagattataggaaatttataagtctgatacttgtgatatgatgctgtcagtcatgattatggttaatatcttaaattcctgcaggtaatggaaacaactaaattttcttgtcgattgtgaacttttatcagatttttaaccatggctattctaagttttttggattctactcaaaaagcatttgtagtcagttgttgtccaagttcttgttatctgtctatagagtagaccacatcccgaattcttctatgttccaccaatccagccttcttccatggaattactataaatggaaaactgttctgttccaaaagccctataagctgaaactagatgaattttaagaaagcagccttgtgcctgatgtatgggccacataaaaagtttacagtggctcacgcctgtaatcccagcactttgggaggccaaggcgggtgaatcacgaggtcaggagatcgaaaccatcctggctaacatggtgaaaccctgtctctactaaaaaatacaaaaaaaattagccaggtgtggtggcacgcacctgtagtcccagctactcaggaggctgaggcaggagaatggcgtgaacctggtcgtgccactgcactccagcctgggcgacagagctagactctgtctcaaaaaaataaaataaaataaaataaaaaataaagtttaccaaaccatttgatgccatgaccagagacaaactgcaaatcaggatgagaagttgacctttgcacactatagacagcttttttcaagacattggaaaagactccatagtataatgagactcctacactccttaaggttacctttctaacttggcaagataatggagtaattgaaatttcacaattactaccttctgcttgtaagttgacagaatctgacctaagagatcctttggtatacattgactaaataagaaaatgtctgtactattgctaatactgcatgccatccctggataaattcctcttggaaagtcaataccaatatacacaaagtaagaaaacaggccacatggttaaaacagatctcacctaattccttatgatcatttgatttattcagtgggttactgatgtggtttggctgtgtccctacccaaatctcatcttgaattgtagctcccataattcccacttgttataggagagatccggtgggggataattgaatcatgggggcggattcctccatgctgctctggtggtagtgaataagtcttaggagatctgatggttttatatggggtttctcctttggcttggctctcattctctcttgcctaccaccatgtaagatgtctcttgctcttccagcatgattgtgagtcctccccggccaagcggaactatgagtcaattaaacctccttcctttgtaacttacccagtctcaagtacgtctttattagcagcatgagaacaaactaatacagttgcctttaagcctaggttcatggataaaaactattatgcaaattgtattttccatttttaaactttttatatgttacttgttaaatttttgcagaagtacaacttgtaaccataatgctagcccatcactttgagataacagcaagactatggaactcacaaaattgaacttaataatggactcaagatagacttagcccgagagtcactcctttcaaacatcctttaaaggtcaactgtgactaaaagggattgacacttactccaagttgccaattgctccctccaaaatggaccaagacctgcaaccaggacaggcccatcccattatccagggacagtcaaaacctaattacagaatgattgattagtgaggtgtttgcagaaagatcttgatcaaaagggagaaattgtgaaagttctcagaatcaaaatggagttaacatgttaaaaaaacaacaaaaaaatcctggcaagctgaattggggaagtttatgaagagaagattcacatgcttgtatacctgataacaaaaactatcacaaatctctaccaaactacaacctttgcaaagaccattgcaaccttactcaaaaatacttctgcaaggacatctgacccgcaattgcccatgcaacctcacattggggtcacctctattattattgatcttagtagccaagaagaactaactcaaacaattatgtaatccttctcacatctcctgtaaaatctaaccttcctgaatatgcatgtagtttactatggcatgcgtattcccactgtgatgccctattctcagatgaacatcattttcttgtaaagagcccttgtctgtttgttatttaggttgacacatacaaaagaatttctgtaagtcggctttgaggattcagggagatagtgtgcataaggcacttggcacaaaatctgatttaagtgctcaataagcattagctttccttagaaaggggctgctcagtccctaagacactcccgagaaggtataacccaatgaaaaccaaattccctgagaccatccacacaatgctgatgagtgggaatgtggggatgacaggctcagccccttcctatgtacccacagaaaggaggaaaatggccaagaagcctcttggaggaagagaagtcatcctgggattaccatatggccctggaattagatttcagtgaacatactatcatcagatcaaatgaatgtatcaaggggccacctgggaagatcaaggaggatccaaaaatccaactgcaccccaggccctcagtggggaagagcacaccctacccccagcacccagggcacagtgtctgcctggactatgcgcttcctcaggccattccaccatcacagaggtctcctgatgcctaattattgccaaataataggggactttcaaacaaatgctatagcctttccatgaaccaactgctctacacatgtgattttgcttagttaggtacaactgtggctgaccatctataatatgaaaatccacacccaaaatgcttcaaaatctgacacttcttgagcaccaacatgatgtttgaaagaaatgctcattagagaatttcagatttcaaattttaggattagggatgctgaaacataagcataatgcacacattccaaaacctgaaaaaaatctaaaaactaaaatatttgtggtcccaagcatttcagttacagaatacacaaccagcaccatattagctccatgttaaattgagaaaatagaggctcagagtagaacactcatctggtcaaggtgacacaggcaatgtgtgcctgagccaggattccagggcccaggcctacaggctggcatcctccctcagtgcaaggtaaacatacccctctgggcaagctactggtgcacctggccagccagactcagacctccggggttgccaacatttcccaggagcagccttgtgggctttgggtcctgggctctcaagggaaggggaaactgaggctaaggtgggcagatgcagctgtgatcacagacccagtcctaaacccagcctcactgagggggaagccctcgtctaagatgctcttgaggcacaggtggattttttacttccccacttggcagatgaagggaggggtggccggccttcccagtgcctccttccacttgtcttcatggcctctaaccccacagggtccacagggaatggttggcaagggctgggaggcttggctggctgtgggaaaaggcagcattgtgtgggaaatacgtgactcagaggcaccgaggagacaacttaccaatgatagtgctttcactgaagataaatctgcaaataacttcatcccgtttctttagattctgaaagccatttccatgaataaccacatggtaggattctgcaaggacagcattcaaaaggttgaatgtggaagagtggagggctgcctctcctctgacctccctgttcctggagatcctcccccaaaactcaacttgcagatactcctgtaaggaaggagcagtgtctgaccaacatctatgtgtccactgggtcaaatcttcatctggtgtcactgagggtccagggggaggcagctgggccttgagcacactcaaggaccctctccctaccatccctgaaccaacacgctcaggaaaggccttggtccttgcacagggcaggctcagagtactattcctgccctgaaatctgtggtgctccctcaggccccaggggtacaggcggtgcactcagccaggccctccctgatgtaaggtgtaagtggagccacaaggctgcctgaagacaccatgtctcatgcctcagctgggcacccaggccttgatgcctccttcagggctgctgaacactcggggtctctcctccctgtctttctgtgtgcctgtggcaggcaggacacccacaggggcaggggcagggccaggactcgggtaggacaggtgaggcacctacgaccctgctcagggcaatccatcacagaagtcctgttttagctgcgattccagagacctacaggtaactcctcatctcctgctcttcctgatccagcaaggaccacagggcacccaccctgaggctcagggagtgtgtccttccaccactgtggctcctgccctgagacaaacaccacaggggacacagggcaggtggggctggcctcaggagtcagcagaccgcaggtctgcagctgccaagggcattggcctccacccctgcctcctggcccaggccccacgcattccaatccctgctgatgcctggggtgcccccagtccatgcacccgaggaaagcttcctctgaaccctgcttcctgctttcctgcagcgtcacaccttcaaggcaggctgtcggtgaagctggcctgctgacatactttctgaggctttcaagtattttcaaaaatgggggctcacagttgaaagcctgaacatttcccctaaatatccagatttctagctttcttaggaaatgggaaatgcaggcctcagtgggtttgtgtttctccgtgtcagctcctggctgggacctagggaaccatgctcctcagatgaggagctcccaggcctgcctcacttcaaggccccacacactgactgctgacatcagccggctgggcctggcctgctcctcctgctcaaggtgccagcccagcccttgtgggcacccacttgatggatactatgctgtcctcagaaaaccctgggcctggtgggggcactgaggctgtgagagagcaggaaaggccagcttggtgccctgtgctgagcaaccagacctggccccactcagggtaagcattgggtgctctcctaccgctaaggcagacaacagctgcttccaaatctgatgctatcaggcagcattctcaacatcttccttgctcaggtgtccaaagggccctggccagtcggacctgagctcagtgtgcccgggagggagcaactgggcctgtggcctgcgccccttggtcagcccaactcggccaccctgagcaggactgagggctgccccaaagcttcacgatcagggtggttgcaaattacattctaagctgtgttaggactacatattctatgtattgcaaacattgttttttttttttgcaaggtggatggatgaaaagagagggagaaggacagacaaaggagcatgggcaaacattcattgtaaaatcccagtggtggatagaggtgtgtttgtgttcattgcacaatcctttccactcacctataggtttgaaaatttcaacaataaaggttggaagaaaaccaaagaactaaagaagaaaattatacttggacatagacaaccggaaatcatgatacaccctgggtgacaagtgactgatgagagggacagaccaagcccttggttgcagggagtcagaggggctggtcatcaggaaaggcttccaggatgaggtgccctatgaacagggctgtgaaggacaggtgggctcggcccttcgaggtgaggcaaggcttgcagagtgcctgtgctccacctggtcccacctctgcacaaggtgcccagaacagggagcggcccctggagggcctgggggttctgctaagagcctcagacacctgccaggctggagagggagatgcctgtcaaaaccctccagccatgtgtgggggatgggctcaggatgggcctggagcagtgaggccaccagaggcctctcccaggctggataggaggcccaggcctgaatgagggagtctgggctgtgtgcctccctccctggcctccttcctgggctccctggagccctcctggtttcttggtgacagcctgctgagagggctcattctgttgcatttgagttccaggctcctgccttggcctttccctcctgtgactgtcaccctccatgtggggcagctttgcacaactcagccaacagctgacaggtcagggctgtgactgcgggccacatgggcagaggcagagggccaagctggtgggcagaggcagagggccgagctggtgggcagagggcacctgtcacctcgactcagctgcctccagggaggagttacaactcacatccccacctggggttgacaggttgacagggctgctcagacgccacagcctgtgcatctccaggggacatcatcagagcacagctgtcacactggctgcatggctgagcagctttaaatcaggagcagcagaaagagaccctgagggggaggggagctctctactctatccccaccctcagctctgcatcggggagaggcggtgtcggggacagagcccaggaccaatcgtagaagtgtcagcacagctcctgttcctgggtcctaccagctcccagccctgtgccagtccctgcacagcccagtgcctagggactcacgacaggcctgacagcgtcctttctgttcatgggaggcacctctggagctcgctgacattggactatttgctctggtcgtgtgcccatggagagcagagctcagacatggaccgtgtgtcggtccccacagcctactgacagggcaccctgcagtgaggaactgggaagccagagcccagctgctgctctggggccagcggcacccagcctcgtgctgtccccatggaagagagtcacccaaggctctcttcctctccagcagcggtagttgcgtaaatgccggccatgcggagtcccagcgtgtgcaggcggaggtcaggacagacgggtcatcacagaggaccacacaatgtcaccacccatgccgggaccccagatggcaagaagtcacccttgccacattccagacagtagggacagatgctgggactgatcctgtgggattgaggtgagctgagggtgtttgtgcggatgcctttgttgggctatggaggtttccttctgctcacagggtgctgtgggatgttgacgcccccacttcttgttcttcatcccctgagataaccgcttggtccctgtttcccgttttgttgatgtggtaaattatacagatatttcaccttctgcacctgcctggccttcctgggaggagccctggctgctcctgccctgtggtctgggttagctgctgttccatgccatttgctggtgtttccctgagaacttctcacacatgtcttttcttgctttagagttaaacttattgttgtgagctaacaacacactaattgtacacaggtactcacaccatcacccctgcatattccccccacagcaatagacactcacattcacacccatgtgggccacacatccacacccactcacccatgcacactgcaccacacacttaacccaccccataccacacacatcacaccacacacaacacgcccgaagcacacacacccacacaccacacacacacataaatcgcaaacacacatacagcaaaaataccaaagacacaccacacatcccacacacacaccacacacatcacacacgcaccacacactctccactcccccaacacacacccagcacaccccacacacacaacataaacagcaaacacgtatacatacaccatacacacacagccatggcacacacacccaccacccactgaatgcacacacaaaatatacatacatgccatcacaccatttccttccctacatgccacacgcacaagatatccccatgtagacacccacatatgacacacacaacacgcccaaacactctagtcccactgtacacacacacaccacagacacacataaatagtaaacacacatactccacaaacagcaaacacacaccacacatcccatacacacacaccacacacacaagtagtacactcccaactcctccacacaacaaactcacacactagacaccacgcaccaggtacccttcccacacacttccacagcaccccagcttatgccacacactctgcgcataccccacacacaccacacacacatgcatatatgccccctacacacactcacacccccacacacatacaacacataccctcctcagctcccacaccacatacacccacaacacaacacacacagatgcatcactcatgcacaccccacacacaccacactcacagcacatatacacacctcacatacagatcacacacacgtttacacaacacacagaccacatattaccctccccgcagacttcacacacttcaagcctcccacagcacaacttcccacacatactatacatactgcacccacacaaattacatacacacataccacacacaccaaacacatacacaccacatacacacaccacactcacacactccccacacacatcctcccccacacataccaaacaaatgcacacactccatacacgcatgcactagtgcacaccaccctttggcaaccgcagggcctccgcagttctcacttcctacacactcagaggaaggctccacagacgtcacttcaagacaggtctttgacatgaggtggaacacaggaggggtggggcagggcagggagagtgagcttctggccacaggagccagacccccagcccctcacctccactcactcacagcatcaacagtgcttctcagggccttgaagccatcctccactgcaaacacatggtccggaccgcctgccattgctgttatctacagagagcagagctggtttggactcccagcccaggggtgagcatgcagcagatccccagcccaagggagagcgtcctgcccccatgctttggaggcagcagaataccaggctctgagggccacagccttctccagccagcagcccactctcagggagtggggagctcttccaccctcccctctggtttagtaggatttatatgacatgctgtcatttctgcagtagtcatagggtggcccaactcacttgaggcagattagatgacccttcttggggtggccctaggaaagctgtctgggacacctttccatactctaaccctaacctgaccacaaggctctatattggtgcctggttaacctgtttggaattactgggtctttcctataatcagccatacccacggtataaatggtggcccccaggctccgagccctttcagcttaagggaaagaaggcattgagtattaattaccaaaatacagggagcaaaatgctgataaatacgaactgaactcacttctttgagagtgtccaaagatggatgtttcatcattgttccatcagtcatagcaataatcatgctggaaaccttgtcatctgcaggagaagcaaggagtggcctgctcagcaaaggccccagaagtgacctccaaaagttcctgtattgggagaaaagctgagtgttgggagagaagctgaggcagggcttgcatgtctgctagacttgctggctccttgcttctagcacttccgttatctcaagcagctgtatgtttctcattcacttgatacactgtttcctttcaacccccacatcctcaccacctgttttttgtttgagcaccaataaacagcatgggctcccagagctcagggcctttgcagcctccacacttgtgatggcccactggtcccactttctctctcaaactgtctttttctcattcctttgactccaccagacttcatcactcccacgatatggtgttgggtctgattagcccaacactccaggacccctgcgggctgctgggcccacagcactgatcactccagggcatgtccaggtgcccccatctcatcctccaggggagaggctgccaagagccaagcacctgctacacagagacccttagagtgagggaggtctcagcccagcacccattttacaaaagaggagctgagaggggcaggctccttctcaccaggctgcctgaaccctcacccactagcagcctgcaccacctctgcctgagggcagctgcagccaggactccacaagcacaggcctgtcccatgggtagggggaggagcagcttggctctcctgtgggcagagcctgcgggcagccctgccagcatctctgggcccaggagtacaggattccaggtaagtggtacctgggcaggggaccccacatccacctcaatgcctttccccaccaaccatgccttttcctgacaagagttgcaggcacactgtggggagggggtcggcagctgtggacagccttctgcatcatctgagacacagtcaagggatgcaagtcactcagaggggaaatgaggaagggaggaggaagactaaggtgtgtgcaagggggaaaaccccttggctcttctcttttccttttcacacagcccagctggagggcaagcacctcagggttatcagcaccagaactgcacacgcaggatcccacacagttctcagaactccatggggcgagggcttactatgctcattgcaccagggagggacctggacctcagaacaggtgagcaacttgctccaagaggcagggcaggtgtggccttgcagagtctgcacacagagctctctgaggctcacgcccagctctgttccacctatgggaccaccatggggacggcaggtgcttaaacctggagttgaaattttccatctgccgaattgcctgcaagaaaatgaagaaatattgagcctggacagtgaaatgttcccactgatgctctaagaccttgtcaactagaatcgattcttggagctcaaggggtgtatacatttctaaaccctgcctgcatgaatatgtgtccttcaggcaccattttctgaagtttgtcgagaccctcttttattttcttcctgaaaaaactccaaaaaagtggttgacgtggaaagacgtggactgctaaaaattacctctcaagctctctgggagccactgctcactgtgcaaggcctcggggatggaggagggggccaagcaagggctctgtcctgctcattccttactgtgacgttgaccatagatgacaggccttctgatctcatcctagttccagagaatgtaggcctggggaatctcaccagggccccacttagaccatctctggtgacagtgggagcttcccatggatgagcaactgtgagtcaggaactgcaatggggccgatattcctaaccctaaccctaaccctgaaccggggatgggcaactgagagtcagtcactgacaatggggttgacattcctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaactctaaactctaactcaactctaacactctaactctaactctaatccaaactctaacccaagaaggactctcttgtgttgggcactccgtcctttaacagggagggctgcatttgggaaaagtcatcctgctaagcccccagccctgcacccagacctcacagccccagacccctgaccctgactcagtttcttcctctctctttaccctggtacaggaaataccaaatctgcttaattagactgcctggactccttgacttcctgtgcccttgaaacaaaaagaccaaaagctggagaggcagccctgacggctgtgcatgcaggggctgaacactgatctgcagactggctgggggatgtggcctgtcagctgctgttaaagcagacagaatgggctggggcagccaggactggctctggtggcaggactgggacaggctggggacttagggtcaggctaatccaatgtgacaggctgagcctgcacagcaaggctgagcagagcatggaccctgaaggatggcttcccactgcgggcagacagtccctgccatggccggagctctaagagccctgcctgcccagctcaggaggggagaaggccagacccatccatacccagaagaggccatggcctggccttcctctggccatgcccaaaccccactccccttctgggtcacccgccacagtcctccccaatagacttgctttttaccacctcacacccactccagtctctctgccaaacccacagcgcaggacacacagatccaagcctccccctagctcaagatgtggcagcccaccttgtatcccctcgaagctgcaaatagggtccaggcccccatccagtcctcagtatcctcacctctctcttgcacttcacctcctctgggcccagttctgggcatgtgcattggaagtgccctcatctcccgccaaacaggaactctgcagtgcaccctgctaggtctgggcacctctctaggccacctcaagccacctgagcttgctcctcctacctccctcccaccagtttcccagcctggcctggagctcagaaccccacacagggactcccctgtctgggcctgccagcatccctgcactaaagccccatgactctcaccactggctctgaccctgtctccctccttcactggccagggcaggaggaacaggcacagagcagcagccagcacaggtgtgtgttcacaggacacacactcccaccctgccagcccctgcaccccaggaatcttcacagccacctcccagggaaggaggcagggtagagggagggcaggggagtgtgaacggggaggctgagaaattctggagcacaggggcctgcaggtaaccttgcagccatgggtaggaggatgcaggggatccggggctaaggtcagggtgggtactgtgagttgccctgaccggccttctccatgtgctgtcaggctcccaaccaaggtctctgggagcccttcagctccctggagctccctatggctcagctcatcaggcctccctttggggctcaaagcagcactcacttgtctgaggtgagtggcaagacagtgtcgccatctgtggagtaggtgacaaaagacatccgcatatttgcgctgagaaggaatcaagtactggtgaaaagccggaggcactggctcagaagccagggtgagtgatgccagttccccacctcccaccccaactctgttatgaattccctgttgtgattaacaggaaggttgacatggtgactttgtgacctgcagctcttcccagtgtcctgcatgttgacaacaccagggggaggcacaggacctttggaggggccacaagaggaagcctccatttcccttacaacagccctcatagtgtcccttaaaacccccagaccctgccatttgtttactggaagagttagcccaggtgacctaggtgaggacattgctgtgggtgaggaggtcaaggactgggaggccagagtgttggcagtgacaggtcatttgtgtgacactgaagtcccccagggggtagcagatctggaaggagacggaaactgcagtgttgccagagtctttgtgaatgagggacattccggttctctactgctgtgcaccagaccaccttcatttagggacacagagcaggcccattttattatgctcacaggttctgaggatcaggcactcggggcagagtgggaagggctcctcgtgtctggggccccagatgggaaggcttgagcagcccaacatgacttgaaggattgggcactggaattatctggaggctgctccactcacaagtgtggctcctgggcaggagggctcaaaagctgggctcagctgggactgcgaatggagaccctgcatgtagcctccctgtgtgacctgggcttcctcccagcatggcagcttcaggatgcttgggcttttacaggtggcccagaggtccaagagtgagtattttcagtgagcaaggcagaaattgtagacttttatgatatcaccttggaagtcacacagtgtcacttccactgtactctattggtccaagcagtcacagctgccaagagtcaatgggagggaacacaggccctctctctagggcagaagtgtggatgagttcacatcccagtgtcaaaactactgtatgacaaatgctttgaatggcagagacgttacagtgtgtggaaaaacgtgggtactgatgatgggattcaagttggactcagaaaagttagactgtgatagttagaaataccttaattttattttcttcatttttgtatgcagaagtgatatatgattaaaaattcttcttcaataagtctaaaatagatctttcaatgtatttgacacaaaaattacaagtgatagccaggaagggtaactcatgcctgtaatctctgcactttgggaagctgaggccagcagatgacttgaggtcaggattttgagagctgcctggccagcatggtgaaaccccatctctactaaaaatacaaaaattagccaggtgtggtggtgcacatctgtaatcccaactactcgggaggctgaggcagaagaatcacttgaatctgtgaggcggaggttgtagattgcaagattgtgccattgcattccagcctgagtgagactcttcctccaaaaaaaaaaacaaaaaattacaagtgataaaaagcactgggttagtggactttggggggtttctgtcttgctttggagtggtgtttaaaacaatggattattttaaataagtggtattttagaatgggtagagttggtgtaattcctctgaaagcatattaggttttcctgcttcacatccttcgtgacccttggtagtgccatattttattttattttatttttaattatgttttgacatctaatcaatagacaaaagtattgtcttaatttgcagtttcctaattactaaacagttgttcatctgttctcatgattttgggtcattcctgtttcctcctttgtgaagtgcctgctcatgcctgtgtgtccattctctgatttgggtgtttatcttttgcgtattgattcattcatattctttaaattctgaatactaatcgtttatcaattgttgcaaatatcttcttccatggtgtggcttgttttttcactctatttgttgtctcttagtaaagcaaaagttgttcattttaatccagttgtttgtcatttttctttttcttttgtttttttgttgttggtggtgatggtggtggtagtggtggtttttgtttgtttgtttgctttgttttgttttgagacagagtctctctctgttgcccaggctggagtgcagtggtgtgatctcggctcactgcaacctctgcctcccgggttcaaacaattctctgcctcagcctcccaagtagctggaattacaggcaacccccaccacgcccagctaatttttgtatttttagtagagatgaggtttcaccatcttggccaggcttgtcttgaactcctgacctcgtgatcaacccgcctcagcctcccaaagtgttgtcattttcttaaactttaagatttgctctgttttatatcttaagaatttcttccgttagaggtgaaatacattttattttacaagttttaaagatttgcctttcacattgaagtcttgattctacctagaattaatttataagtgtgatttgtgccagatatttgatttcattttttgccatgaagctaacaaattgtcccagctccatttgtggaaaattccatcttttgcctattgatctcgtcactacttgtgtttcaagttccatatagatttgaatctgtttttatttatttatttattttgagatggagtctttctctgttgcccaggctgtgtagtgcagtggcaccatctcaactcactgcaacctctgcctcccaggttcaagcgattataatgcctcagtctcccgagtggctgggattacaggcactaggatgtgcagcgttccttgggaacctggggtggatacgtgggagaatgatatatacacatgagaaatatagtttgtgcttttcagatgattaaattgggagagggaagggggtaaccagaagataacctagactcatctgacacatacacaaagttcttcacatacacactgcgcctggctaatttttgtatttttagtacagactaggtttcaccacgttggccaggctgccaatctctatctattggcttatattgatagcatccataccacattatcttaatgactatatggaggaagactgtattactgtccatcattgtccctttccatttaagggaagggctgcgctccctgccatgtttgtggcaggttttgattgaccaatggaatgttaacagaagtaatgtgtgccacttctggacagaaaatgtttaagagtctaggtatgacttaggtggccccgacagcctggtgcctgagcaactaggatgtgtggcgttcccttgggaacctggaatggatacgtgggagaatgatatatacacatgagaaatatagtttgtgcttttcagatgattaaatggggagagggaagggggtatctggaagataacctagactcatctgacacatatacaaagttctacagcaagtcttcacacaatacggtcaatcatccacttttttttcttctggttattgttggctatttgctctttgacataaattttagaatcagctcatcgagtctcctctctcccaaaaacttcttaatgtttgattacaataacattaaatgtatggattcatttggaagaaacaggtctgcagtgagagttgtcctatcagtgaatatgacacatggcatatgtctgtttatacaggtcttttccagtgcctttcagataaattcccctatgaagattttgacctcattggtccagtgccttcccaaaatacactacattttactactattgtaaatgataatttaaaagtttttaaactgtgtatcatatacagaaatgtacttacatgtttatatattgacccacctcactaaactctcttctatgaatttatctgtagattcattttgatttcttgtaaaatataattttttttaaaaaaagaataagaattgtgctgactagttctccaatccaatgttgactagtgatggaggcactcttgattttacagagaatgtttctaacatcacaattaacaatgatattctttgaaggcttttggtagaaattctttatcagattagaaagtttctctactaatcttggtttgctacaagtcacaaacaagtgttttatctaaatgcttcttctggtattttgtgatgaacatgtatttctgtccagtaatctaaatttagtatgtttagatacattaatgcatgcaaaaccaattttaaaatgctataaataaacctaacttggccatgatattttaaaacatgctagagtttagtcataatttagaacttgttgtttatctatgatcatgagagagatgggtccatactttccgatttctgtgctgtccttatctgtttttggtattaggtcataggagactcataaaatgcacctggaggtttgctctttctcctaggaaggactttgaacatgataaatataatctgctctttgaatatctggtatgatatcatccttgcgttttcttttgagaagactttaaaatgatataatttaataatttctggatgttatgaattctgtctcccccaaaatgggtatgttgaagccctcactggtgatgtgactgaattattaggacataggggctttaaggaggtaattaaggttaaatgaggccataagattaagcccttaatcaactaggactgatgtccttacaagaagagagacgccagagttttctcttcaaggatgcacagagcaaaggccatgtgaaaactccatgagaaggtctctgcaagccaagaagaggagtctcatcagagaccaatcctggtggcaccttgatcatagactttcagcctccaggactggttgcaaataaatttttattgtttaagccccccagcctgtggtattttcttatgacacccagagcagactaacatttatttatttattttttattattatttttgagatggagactcactttgtcgcccaggttggagtgcagtggcgtgatgttggctcactgcaacctctgcttcccaggctcaagagattctcctgcctcagcctcgagagtagctgagattacagggacgcgccaccaggctcagttaatttttgtatttttagtagagacagggtttcactgtgttgcccaggctggtcttgaactcctgacctcaagtgatcagcccgccttggatcccaaagtgctgggattacagccatgagccaccatgcctggccctaatacttacttagtgtttctgtttctgtcaattcatatgacatatttttctaggaatttgaacattaattagcatgccttgttataaagttgttcagaatgtttttaattcttatatttctgctctatctgtagttacatctttttaattcctattattgcttagttgtgccttctctttttctaggcattctaaacagggaggatattgtccctaaaggagtgaaaattagccttgtgtgggtcttactcttttaaaatataaaacgcagatatgtatacagtacataaagggcaatctagtatatatgtggaatcaaaatttcatgggggttaacgaggagatactattaagaaaaataaagcctaaaacatttcccaggatggggagattagaatgaaaaacagaaaaggataggaagcactgtcttgttttctgatcaatttcactagcgtattgtctatgttagcaaacctttcaaataacctttagatttgttattactctctattgcattttttgttttctatttatagttatttatttaatatcctctacctttcactttctgtgggttcattttgctactctttttctcatattttcatttagattattagctctttattttcaaccctctttgctgcaaaataaacctaataggccgcaaatttccctctaagtttctctttcactgaatctcataagttttcatatttaatattttattatcagttgattttaatttcagtgttgatttctactttgatacattcaattttcaacttccaattttatgtggttttaaaaaattctttttgtcattgatttccaacctaatcgcattataatcagagaacatggtctgtatgatactgtttctttgaattttattgagatttgtttcaatacatgatttgggggaggattctttagaagaccattaaaaccaagtttattaattgtgttgttcaaatcttctaagtttttagtaacactgtgtctactcaacacatgcgtgttgaaatttctcaaatacatggtgggtttcacaatttctccttatagtttatgttttttgttttattttattaggtgcatgcaagtttagaattgttatggctgtctagaaaatgcagctgattgggaactgatcctcttaaaccctggtcacgctttctctgtgctgaagactcccgcttccttttggtttccccagcatcccggccacatctctgtatcttttcccatccttttatgttaaacttttttatgtccttatgtattagatgtgtctctttttgaaagtatatagctggtttctgttgttgttgttgttgttttgagacatggtctcactctgttgcccaggctggagtgcagtggtgcgatattggcttactgcaacctctgcctcctgggttcaagacattctcgtgcctcagcctcccgagtacctgagactacaggtgcacacctacacattcgattagtttttgtattttttttggtagtgacggggattcaccatgttggccaggctggtctcgaactcctgacctcgaatgatccgcctaccttggcctcccaaagtcctgggattataggtgtgatcccaccctgcccagccaatttttgtttaagagtcagggcctcactctgttgcccaagccagagtgcagtggtgcactcatagctcactataacctggaacttctaggctcaagtgatcctcctgcctcccacagtccggtaagtaggactatagtgtgcgccaccacacccacctatttttgttttctgtggtttctttttttggttttttttgtttgtttgtttgtttgtttgtttgagagaaaggttcttgctatgttgcacagactggcctcaagcagtcctcccacatctgcctcccagagctatggaattacaggcatgagccacggtgctggattggatttttttttctttttcttttcttttttagcagacaaattttgactttaaatggcaagttaagtacattgtggggagcacgaaactgcaccaatcagatctctgactgtggggagtaggactaggggaagggagtgttttgggaatccactctctaccaccacaatgggccaccacattcacagaaagaccacatccctcacaggcttcttttagccagaggccagcagggatatgaaaacaggcccatgcctaggaaatctcagactcctcagatggctcaaggtctcccaagctgcttggataaactttcctggaagtggtctccctctgaaattattctatccttttattttcagaaaactccccatattggtgatggtcattattttccgtacctagccactcaccttaatcagtgtgttcccagcttctttgctcaccgtcatttcttgaactccactcttccaaattgtttccttctttctgaaatacattcttatcctttcatcaaggttgtacaggttgtaaactcacactttgcacatctgacaataccttcattttgtgctcacacttgatttatattccagatagatacagaattctatttttgaggcacccaaggacatatcactggtggctgtggcaactttatcattggtttcaccaccagtctttcctgggtaatctgtgttttgagtttggtgactttcaaattgttttctttgtctctgatgttctgcatttcggatttgatgtctctctctattcctcaatgttctctcttccataaaagaaaagttttgcttcaggactgtcagaggcagtcaaaccagaacgactccattttgagtgagggctaggaaaatgaggcggggacttgctgggctgcgttctcagaaagctaggcattcctcgcctctagatgttcacagttaagggaacaaattaataatgtttactaaacagacccagacttgggagtatccagatatcaagatatctggagaacaacggcattcctaattttgctttaaagataatattgatgcttgcaaaatagagtaattaagaaaatgaatcctttatcacaaacccttttgcagagcacatctccccatctacacaagcgttgtacctaggatgggggctttactcctcttactttcgggaacgtcccactctgtctatggagtagctgcactttgaccacttgactttcttaataaacttgcttttgctttgcactgcagactcgccctgaattctttcttgcgtaagattcaagaaccctctcttggtgtttagatggggacccctttcctgtaacaggaccatctctaaggtttgatatatgttctgaacccaacttccccctcatcagacttatgtttgtccttgaggatctcatctttgcaacagaccctccaaagccttggagagaaactcagcgcttcctcacggtatctccgcgcacccactcacccctaccacgtcagaacacccactgagtgacggaattaatcaatgagggagcagggactcggggtggttttcctttcagtacttgaagaattctcccttctccaaaggaagctactttgcaccctacgctcaagcaatgtgacccatgcacacttgcctgcaacagcaccaagaactgcaattacctgagactctatcccatctaccctcactccaccactgcaggggaaagcccaggtcctccgagtcccagcgcagtctccacccaccccacagtcattccgtccagaccacggcccttctgccctggccccctgccaccctccaggggcagttaagtccctggacacctctatgttctaagggtcgcggagccccccttcctggcaaagtgctgcgcggtcacagctggggcgaggggagcggaggtgtcggggcgctcctggaggatctgggctacttgggccctggggaggtgccgctagcggggccgccaggtcgcgcggggagggagagccgggaggccacggaggtcctccgcgaagagggagccacaggcacggggcgcatcgccgcggcccccctggcgcaggagtgagaggtcggggagcctagagccagagggccgcagcgagagctggagccgccttcaagggatgccctcgccctcccgcaggcgccggcgcccggcccagcccgagccatcagagggctgtccgccgagctgagcccggggagggctgggctgcccagctgatcagaggctttctcccggattgcgagttctctggcccgcggcaccctcccgcgcgggggccgcccacccacaagccctgccccgaaggcgtgtgcggccaggaaggcggggcctggtgtcctcagggctctggcgccaagttcagagccgcgcgctgggcgcttggcggtggcggccgcgtctgcacctcctccctgcgcgccgcctgacagtctggagagacaacttagcttgagcccattttacagatggaaacccgaggctcagagaggttgagtgctttgctcagggttactgagaggagtgaggtttctgcatctgcctcttcggaggcattggctgaaattcatctctgatgtcaggcaccccctctgaggaatctgctcggaaaaggcatcgggagctgcagcacgtggtttgcatcctctccatgcaacaaaggacctagacttccaggagtcacagggtagtctgcagggcagggtagagatgttccacagaagctggtcaaaagctggaatatcattaaagatcacaatataccacaacatcaggttccattatttctgaggaggcaaagcaactacatattttagaaatttactgttaatttcttatttccagtcagtctcacccaaatgtttcaagtgcaaagccctggcctcccactgtcttcccacaacccaggtctgtatcctgtcccttgcctcccctgcacctggcattgcacagaaggtgtgggtggcaatgtcccctaaaagcttctgcaaggcttagcttcctgctgtgctgtctgtgcctctatgagtaaacgcaaaatgtcaagaaaaggattcaattgtcttgtatctaaaaccaggtatttttttcaggtgaccctgaaaattcagagatttataatttgatcatctatgtactttttcccaggaaaggcactgaacgggttacatgtgcagatctttgtatatactctgttggagaaaggatctgggctgaagacgccagcacctagcacaagccctggatgagaataatggggcactacaagatgaacagagagagggctggggcggggaggggtggatgcaaacgattatggccaagaagtcaccttaggggaaaaacataagaagaattcttgcttgcaagagagaaggaagcctatagggagagtgaggggagaggccgaaagagagagaaggaaaaaggataaaagagaaatagccaacaaggcggacacaagaaaaagggagagatgagagaaacaggagaggacaaggagacaagaagcagagaggcaagagacagggacagcaatgggactcggaaaggacatgggagagagctggaggaagctgacagagggaagggaagaaccccccgccgtcaaaggcaggactcaagaacgctgcctttcgtgcaagtgagatgggctccgctgcccgcgcccgcttgttctcggtcttggccgacctgagggtgcgtctctcccgggctctccagaggcgcgcagggggggaagtgcagacgcggccgccaccgcccagcccagggcgcggctctgaacttggcgccagcgcccagaggccaccaggccccgccttcctggctgcacccgccttcggggcggggcttgcggttgggcggctccggcgggtagggcgtcgcgggccagagaaacggcaacctgggagaaacccccctattgatccgttgggcggcccggccctcccccggctcagctccccggagccacccccagctggctcggaccgggactggcgcctgcgactatgcctgcgggagggcgagggcgtcctttggaggcggttccctctcacgccgccgccctctggctcctgggcctgccgggtctcggcgatgggcgagggctgtgcccggtgcctgcggctccctccgcgccgtggacccccgcggcctcccggccttccttaccccggcggcctggcggccccgcgagcttcacctccccagcatccgaatcgcgcagctcctcccgcgagcgcccgccgccttcgctccccaggccccagctgagaccgccaggaaggcgggctcctcgaccccagatcataagaggtgtctgggaactaagggtgggagggggccagggtagaaaatgtcagttcaagtacgttaaaattaagaacttaggctttgtttaaaaaacaataaatgaagtgaaaaaaacaagccacagagtaaaagaagatacttgcagcaagtgataaaggattagtatccaggatatataaagactgttattgagtcaatgtgaaagagaaaaacacctgaagcaaagaatggatgccggcattaaataggcacttcaaagaggaaccatgaacgaccaaaatcaagtgagtaggtgaccagttcccattagtaattaggaaatagcaaattaagaccacaaagagggcagtgagggtggctcacacacctctaatctcagcgcttgggagtccagggccagaggatcccttgaggccaggaggtggagtctagcctgggaaacatagcaagaccctgtctctacaaaaaaataaataaataaaataagaaaaaagtaaaccacaaggagatgacttaccaccaggcaaaaatattaaagtatgctaataccaagtatcaagaagaatgaagcaagatagctcaaatatgcttttgaaggaaatatactgggcttcattcattctgaaataccccttatttaagatactctattatattaaatacagttccaaaacaaaagaaatcaaagaacaaaaaactaacccaatacttttatcacttgtaatttgtatattacacatattgaaagatatattttagacttattagagaacgatttttaattggatatcactcttgtgcatacaaaataaaataaaattgattaaggtgtttctaacagttacagtctgacttttctgagtcctgtttgagtctcactcattggtgcctacgtctttccacacactgtaacctctctgctattcaaagcgttggtcatacagcagttttgacactgggatgtgaacctgtccacattctttccctagagagggggcctgtgttcctgcccattgactcttggcagctgtgactgcttggaccaatagagcacagtggaagtgacactgtgtgacttccaaggtgatgtcataaaaagctctacagtttctgccgtgctcactgaaaatactcactcttggacctctgggccacctgtaaaagcccaagcaccctgaagctgccatgctgggaggaagcccaggtcacacggggaggctacatgcagggtctccattcacagtcccagctgagcccaggttttgggccctcctgcctaggagccacacttgtgagtggagcagcctccagataattccagtgcccaatccttcaagttatggggccccagacatgaggagccctcctaactccgccctgagtgcctgatcctcagaacctgtgagcataataaaatgggcctgttctgtgtccctaaatgtaggtggtctgttacacagcagtagagaaccggaatgtccctcattcacaaagactctggcaacactgcagtttccatctccttcccgaactgccatctcctgggggacttcagtgtcacacaaataacctcccattgccaacactctggcctcccagtccttgacctcctcacccacagcaatgtcctcacctaactcacctgggctaactcttccaatgaacaaacagcagggtctagtggttttaagggacactgtgagggctgttataagggaaatggaggcttcctcttgtagcccctccaaaggtcctgtgcctccccctgatgttgtcaacatgcaggacattgggaagagctgcaggtcacaaagtcaccatgtcaaccttcctgtcaaccataacagagaattctgtccccagggtgggggaagggccaggcaggtagctggaagcaagtctcccagagccagctgctgaccctagtccctgcgatctggggaggtacctggtggagggccatagtgtgcactggtgaaagggcaggaggaggggtgtggccccgggcataaggggaggcggcaaagaaggggcctgtgctcagcctctctgggccctggcacaggcacccaagagtgaggtggggtcacagggacagccagataatggggagccatgagtccctggggccctacttcctggtcttcctgctgctgctgctgcttcctccaccgctttttagagcaggaagccttcggtaccatggacctgactggagaatatttcaccgcctggccctgggctccaggagagcccaccaccaccatggcccaggatggaggcagcactggcgccaggggcaagcaggtcacagatgccagggctcatttgacctctacttcatcttggacaagtgagtgtcccttctagctctggccctgggtcaccctcaggagccactgtctctttttcactagggacaggacaccactcaaggagatgcaagcttccgtcacagaagcagggccaaactttggtcagaccagacctaggcctcctgtttttctgaggcagaaagaatgccctggctttcttttccctggtgcttcatctcctggatgaggaaaaaagccaccaaaggggttctggacgattccctacccctccatcagctgggtcagcatcctcatcctcacgctgctgcaacagatgattgctcggacctgcctctcagcagttctcagatgctcactgcggatgtttggggtttctgtgttgttttgcttgtttgttttttcacgcaaatgacttctattttactgggccccacagagattgctttgttgcctgtgttgggcattctaatgtcactgcttagagaaggcctttggttggctgcttctaagtgcctcttctgcaacttggagagccacgcgatagttcctacactttcagaacagtttggtctgtttcaggctggccctggggaagctgggctacgtattaggcaccttctggctcaccaggaaagaaaagaggcaaatgttcagctttggagagattgccttggttccctttcctgctcctcctgctgggtggtaatactctgtgcttattcagtagcagcagtggtgcaatcttcaggagaatgttgcagcactttctggcctccaaagcccttcccctgcactcctggcacctcaccacaatcctgggctgtgagtagtacaggtatttttctatctggttcctggacaagggtggctcctggaggttggggaagcatccagagacagctagtgtgacaagactccggcttcctgtgctgcacactttccagcatcgcaggttgaaattcctctgatttttctcattcctcctggatactaatggttaggggacgtgtaccccagcccaccaattcccatggtttctgactgttctgctactcttggggaaggagcaactcagttctggagacaggcagagtccactcactagccacatagtcttgggcaagttgcttcatcattctgtgccttcgtgtcccccatctgtaaaaagggtatcttcattttcaccttgccaagtgtgatgaggatgaagggagaatttgcaggtcagaggcgatgacagaggatggggatgaagggacctgccaggcaaggcagagccacaggctagaaactcacaggaactgcagaggccctgatgtaatcccagacagactggatgagggggaatgcagagggagtgcctagagtggatgtaaagggagcagacaaaagcaaccttaatgagtcttcctaacaaggctgggggtaaagggcattgccccattctaaggaggaggcaatgagccaggtcatggccagggaatgacccaccacagcctccagatagaccatggtgctgaattgaaactctggattttgtgactccaaagcccatccaaagaccacgcagctgggcgggaccctgagaaacttgcggtaatcctccaggcagaaacaacatctactgcctgcaggcaggctctttggtcattagcgtccagcttattcatgagactcattattcacttgttcattgattggattgagctggaagaaaatgaatcagcctcccatgcgctcctattcttggccaggtgacatttgagggctctaagtgggaatgaccccttgtattttttgagtaattttttaattgtgggaaaacatacataacaaaaatttaccatttttaagtgtacaattcagcggcattaagtacattcacagtgttgtgcaatcaccaccatccatctccagaaatgtttcatcattgcgtattgaaactctattctcagccgggagcagtagctccctcctgtaatcccagcaatttgggagccaaggcaagaggatcgcttgagtctaggagttcaagatcagcctgggaaacatgcaaaatcctgtccatacaaaacatacaaaaattagccaggcatggtgatgtgtgcctccactcccagctactcagcctgagctgaggcaggaggatcgcttgagcctgagaggtcaagactgctgtgtgtcaagattacaccactgcactccatcctgggcgacagagtgagaccctgtctcaaaccccatccccatcaaaacccaaaaaacttctatttccattaaacaataactccccattcctcccttccccaagccctagtgacctttagtgtattttctctatctatgagtttgcctattgtaggtacttcatgtaaggggagtcacacaatgtaatcaagcaaacatataatatttggccttttctgtctgacctttttcacttagcataatgttttcaagtttatcccatgttgtcgcatccatcagaatttcatcccttttatggctgaataatatttctctgtatgtatatgtaccacattttctttatcttttttttttttttttttgagttggagtattctgctgcctggctggagttcagcggcgcgatctcggctcattgcaacctccacctcccagtttcaagcgattctccctgcatcagcctcctgagtagctgggactacaggggcatgccaccacgccaggctaatttttgtattttttagtacatacagggtttcaccatattggacaggttggtcttgaactcctgacctcgtgattccccggccttggccttccaaagcgctgggattccaagcgtgagccacctcgcccggcctgtttatcttttcgtctgttgatggacacttgggttgcttctgccatttggcaattgtgaataatgctgctatgaacgctggtgtatacgtatctcttggagtccctactctcacttctttttggtatatgccagggagtgcaattgatggatcctatggtgatcctatgtttagctttctgaggaaatgccaagctgtttcccacagtgattgcaccattttgcattcccaccaacaaaagcccaacatttgctattttctggtttttgataatagtcaccccaatgggtgtgaagttgtatctccttgaggctttcattggcatttccctagtgactagtgatgtggagcatcttttcatgtgcttattggccatttgcatatcttctttgaggaaatgtctattcaaatcctttgcccattttttttgttgcatttttttgttgtttctttttcgttgttgttgtaggagttctttgtatattctggatattaatcccttatcaggtatatgagttgtaaatatttcctcccattctgcaggttgtcttttcactcctttggtagtgtcctttgatgcacaaaagtttttaatctggatacagtctcaacttttctatttttaattttgttgcctgtgtttttggtgccatatccaaaaaaatccccaaatctaatgtcataaaagttatgttttctactaagagcttaaaagttttagcctttacatttaggtctttgacccattttgagtgaatttctgtaatggtttacagaagggtccaacttcattcttttgcacatagacatccaattttccctgcaccatttcttgaaactactgttctttcccacactgagtgttcttagcacactggttggaaatcgtttgaccacagacatgacaggttatttctgagctctctgttctgttcattgctctacatgtcagtccttacatcagtgccataatagtttgattactgtagctttgtaataaattctgaaatcaggaaatgtgtatcctcaatcttgttcttctttttcagatttttttttttgctgtatgactaatgtcccttgaaattccatatgaaatctagtgcaaatttttttatttctgcaaaaaatgctgtagagattttgatacagattacattgttatcttaacaatattattattgtgccttctgattcataagcatgcaatatctttccatttattgtgtctttaaattctttcagcaatgttctatagttttcagtacacatttctttagcttccttgtttaaatttattcttaagtattttgttctgtttgatgctatcataaatgaaacttttttggttgattttctatatttggattgttcactgggggcttttccaaccagtacattctctcccatttccactctacacagtgccccacctaacctgatcagccacctggatggcaacaaaagccccacatcccaggaagctcctcagtcccaggcagatggggctgggtggtcaccttatgctgaccactcaactggtgaaactcatgacctcggatgatccagtggccactgggggtgtaccccagcctcagctgtgctggggtcaggagagcttgttaagagcctgctgggaggctgggggcggggcagacacttgcccatcggagagatgcactcatctccctgacccacatctccttttgttttaggtctggcagcgtgaacaataactggattgacctttatatgtgggtggaggaaacagtggcgaggttccaaaggtacagatctctgcatggcagcctcccctgagctgcagagagcttttcttctggaaggcaggcagagggcacatcccatcagatggggtgggcgtgggagtccttcagtgggggacacagagcacaaggtggcattctgaagcaggaatgaggccagcactcactggttccatggggtctcagcggccttggctggctcctgcctgtgagcccagacatattgcaggggaggcagtttgcccttggggacatcacacgctgggaagggacaataggcagggaaaccagtgactcagtcctggaactccgagttgctgagggttcaagtagggggcaaagaactccgtggaaggttaaaggaaaaaacaggaactcctaaggacaaagtcaaggatggcttccaaggatgtgggtctttgaactgggtcttgcaggatggaaaagacaggggacctgtggtggcgtgagtggtctgacttggctgggaatgagattagctcagggagggctgggagagggctgggcaggtcagcttgaggccaaagccacaggggctcattatgccaggccaaggagctgggatttcctgctctgagccatagagagccagagaaggctcttgagcaggggagtggcatgatcaagatggcacttaaggaagaaaagtctgatgactgtgggtaaaatgaatgggcaacaagggcaggagccatggggagctccgctggggacgtatggcagcactgtcgctgagggccactgagggtcagccggcaggaaggagggtcagggagaggaaggggaggctgtgtgcatggctgccaatagggagagtcacttgtctgagatgaaggagggatgacggagaggagagggaggagggaatggggtgaagaggcaaagaattttccagtagaagggaggccagctgggagggctgtatgtgcatctccctgcctgttcattataaggtatgtgtgtctgtgtgtgtgtgtgtgcaggtgcctgagtgtgggtgccgtgtgtgcgtgttcatatgagtgtgtgcatgttcaggtgcatgtgtgtgggtgcatatgtgtgtgactgtgtgtgtgtgtgagtgtgtatgcatgtgtgtgggggggtgtgtatacctgtgcgtgtgtgagagtgtgtgcgtgtgtgcctgtgtgtgtgtgcgtgtgtgcctgtgtgtgagtgtgtgcgtgtgtgcgtgcatgtgtgtgcatgtgagtgtgcctgtgtgtgagtgtgtgcctgtgtgtgtgagtgtgtgcctgtgtgtgggtgtgtgcgtgtatgggtgcatgtgtatgggtgcatgtgtgagtgtgtgtgtatgcatgtgtgtgggtgtttgtgtggtgtgtgcacctgtgtgtgtgtgtgcctctgtgtgtgcatgtgtgtgcatatgtgtgtgagtgtgtgcctgtgtgtgcgcgtgtgtgtgtgcaagtgtctttggggtgttgggagtgtggggatgcagtgagttgccatcctgactctcccttctatggagcccttgtctccacaggcctcagagtccttcactacatttatctcacctccttgtgtccagcaaggggctccaaagcggaagagttggggtgggaggtggggaattggcctcaccaccttggcttctgagcctgtgccactggcttctcaccagcacatgattccttcacagcccaaatattcggatgtgcttcatcacctactccacagacggccagactgtcttgccactcacctcagacaagtgagtgctgctttgagccccaaagggaggcctgatgagcttggccagagggagctccagggagctgaagggctcccggagaccttggttgggagcctgacagcacacagggcaggccggtcagggcaactcacagtacccacctgaccttagccccggctcccctgcatcctcctacccatggctgcaaggttacctgcaggcccctgtgctccagaagttctcagcctcccccacttcacgctcccctgccctctctccgctctgcctccttccctgaaaggtggctgtgaggattcccagggtgcaggggctggcagggcgggggtgtgtgtcctgtgaacacacacctgtgctggctgctgctctgtgcctgttccccctgccctgaccagtgtgggagggagacagggtcaaagctggtggtgggagtagtggggctttagtgcagggatgctggcaggcccagactggggagcccctgggtggggttctgagctccagggcaggctgggaaagtggagggaggcaggaggaacaagctcaggaggctggagcccaggcccagcagggagcacagcagagttcctgtttggccggaggtgagggcacttccaatgcacatgcccggaactgggcccagaggagatgaagcacagaagagaggtgaggacactgaggactggatgggggactgggccccacttgcagtttcgagggaatacagagtaggggagcttgagtctgtgtgtcctgcgctgtgggtttgtcagagagactgggtgggtgtgaggtggtaaaaagcaagtctatgggggaggactgtggcgagtgacccagacggggagcggggtttgggcatggccagaggaaggccagggcatggcctcttctgggtatggatgggtctggcctcctcccctcctgggctgggcaggcagggctctcagagctccggccatggcagggactctctgcccacagtgggaagccatccttcagggtccatgctctgctcagccttgctgtgcaggctcagcctgtcacattgaattagcctgaccctaagtccccagcctgtcccagtcctgccaccagagccagtcctgactgccccagcccattctgtctgctttaacagcaactgacaggcctcatgccccggccagtccgcagatcagtgttcagcccctgcatgcacagctgtcggggctgcctctccagcctttggtctttttgtttcaggggcacagaaagtcaaggaggccagacactctaagcagatttgctacttcctgtatcagggtaaagatagagcaggaaactgagtcagggtcaggggtctggggtcattgggctgggtgcagggctggtggcttagcaggatgacttttcccaaatgcagccctacctgttaaaggacggagtgcccaacacaacagcgtccttgttagggttagaatttggattagagttagagttagagttaggaatgtcaaccccattgacagtggctgactctcagttgcccatccctggttcagggttaaggttagggtttgggttagagttagagttagagttagagttagagttagagttagagttaggaatgtcaaccccattgtcagtggctgactctcagttgcccatccctggttcagggttaaagttagggtttgggttagagttagagttagagttagagttagagttagagttaggaatgtcaaccccattgtcagtggctgactctcagttgcccatccctggttcagggttagggttagggttaggtttaggaaagtcagccccattgcagttcctgactcacagttgctcatccatgggaaactcctactgtcaccagagatggtccaagcagggccctggtgaagttccccaggcctgcattctctgtaactcggatgagctcagaagggcttgaaatctctggtcaaaatcacaatgaggaatgaggaggacaaagcccttgcctgggcccctccttcatccaggaggactggcgcaaagaacagtggctcccggagagcttgggagctgatttttaacagtcaatgtctttccaggtcaaccacctttttaaatttttttcaggaatagaataaaaaacggtcttgaccaacttcagaaaattgtgcctgacggtcacacattcatgcaggcaggatttagaaaggtatagaccccttgatctcctaaccctaaccctaaccctaaccctaacctacaaaatcttagagcatcagtgggagcatctcactgtccaggctcaatatttcttcattttcttgcaggcaattcaacagatcgaaagtttcaactccggaagtaagcacctgccgtccccctggtggtcctgtagggggaacagagctgggtgtgagcctcagagagctctgtgtgcagaatctgcaaggccacacctgccctgcctcttggagcaagttgctcacctgctctgagctccaggtccctccctggtgcaatgagcatagtaagccctcaccccatggagttctgagaactgtgtgggatcctgcgtgtgcagttctggtgctcataaccctgaggtgcttgccctccagctgggctgtgtgaaaaggacaagggaagagccaaggggtttgccccttgcacacaccttagccttcctcctcccttgcatgtcttccctccgagtgacttgcatcccctgaccctgtctcatatggtacagaaggctgtccagggcccccaacttccctccccactgtgttgctgcagctcttgtcaggaaaaggcagggctggagaggaaaggcgttgaggtggctgtggggtcccctgcccaggtgccactggcctggagtcctgaactcctgggcccagagatgccggcagggctgcctgcaggctctgcttacagcaagacctggccccctgggagcctccctgagcctgtctgttacaggagggcccagcagctcctccctctgcccgtgggacaggcctgtggttgtggagtcctggctggagctgccctcaggcagaggtggtgcaggtcgctagtgggtgagggttcaggcagcctggtgtgaaagaccctgcccctctcagccccttctctgtaaaatgggtgctgggctgagacctccctgactctaggaggtctctgggtggcaggtgcttgggtcttggcagcctctcctctggaggatgaggtgggggcacgtggccatgccctggagtgggcagcgctgtgggcccagccatctgcaggggttccggagcttctggaggtcactcctggtgcctttgctgagcaggccactctttgcttcttctacagacaaggttcccagcatgattattgctatgactgatggagaactggtggcacatgcatttcaggacactctcagagaagtgagtccagttcatacttaccagcattttgctccatgtattttgatgaccaatatgcaatgccttctttcccttaggctcaaaaggctcggaaactgggggccaacgtttacaccctgggtgtggctgattataatctggatcaggtaattccaagcaggtaaccaggcgccactttcaagcctagtggtcactttcgagccaaccgtcccgggccaccccaaggacggttgtctaagctgccccaagtgagttgggccaactcatggccactgcagaagtgattgacagcatgttgtataaatcccaccatgccaaaggggagggtggaagagctccccgctccctaagagtgggctgctggctggagaagtctgtgacattcagagcctgacattctgctgcccccaaagcatgagggcaagacactgtctcctgggccgggggtctgctgcatcctcacctcctggtggggagtccaacccagctctgctctctgtagataacagcaattgcagacagccctggccacgtgtttgcagtggagaatggcttcaaggccctgagaagcaccattgatgccgtgagtgggcagaggtgaggggctggggacctggatcctttggcaggaagctcactctccctgtcccgccccacccctcctgtgttccagctcacgtcaaaggtctgtcttgatgtgacatcggtggagccttcctctgagtgtgtaggaggtgagagctgcggaggccctggggtagccaaagggtggtgtgcatgagtgcatgcgtgtatggagtgtgtgcatttgtttggtatgtgtgggggaggatgtgtgtggggagtgtgtgagtgtggtgtgtgtatgtggtgtgtatgtgtttggtgtgtgtggtatgtgtgtatgtagtttgtgtgggtgcagtatgtgtagtatgtctgggaagttgtgctgtgggaggcttgatgtgtgtgaaatctgcgggagagggtaatatgtggtctgtgtgctgtggaaatgtgtgtgagattgtgtggggtgtgtatatgtgctgtgagtgtggtgtgtgtggggtgtgcatgagtgatgcatctgtgtgtgttgtattgtggggtgtatgttgtgtgggagctgaggtgctgtgtaatatgcatgtgggggtgtgagtgtacgtagggagcatatatgcgtgtgtgtgtgtggtgtatgtgcactgtgtgtgtctggcatgagtgggggtcttgtgggagtgtgtgggaaggttgcctggtgtgtggaaggctgctggtgtgtgggaagggtgtctggtgtgcaggtatgtggtgtccagtgtgtgtttgtgtcgtatggggagttgggagtgtgttgctgatgtgtgtggtgtgtgtatgggatgtgtggtgtgtctttggtatttttggtgtatgtgtgtttgctatttatgtgtgtgtgtggtgtgtgggtgtgtgtacttcgggtgtgtggtgtgtggtgtgatgtgtgtggtatggggtgggttgagtgtgtttgtggtccagtgtgcatgggtcggtgggagtggacatgtggcccacatggatgtgaatgtgtctattggtgtgggggcaatatgcgggggtggtggtgtgagtacctttgtacaattagtgtgttgtaacctcacaacggtaagtttaactctaaagcaagaaaagacatgtgtgagaagctctcagggaaacaccagcaaatggcatggagtagcagctaacccagaccacagggcaggagcagccagggctcctcccaggaaggccaggcaggtgcaggagctgaaatgtctgtgtaatttaccacatcaacaaaataggaaacaggaaccaagcggttatctcaggggatgaagaacaagaagtaggggtgtcaacatcccacagcaccctatgagcagaaggaaacttccatagcccgacaaagtcgtccacacaaacaccctcagctcacctcaatcccacaggatcaatcccagtgcctgtccatgctgtctgagacgtagcgaggatgccctcttgtcagctggggtcccagtatgggttgtgacagtcctgtgtgggcctctgtgatgcctctgtctgtcctgagctctttctgtgtaggctgggggtctgcatggccggcagttgcacaactgcggctgctggagttgaagggagccctgggtgtcctcccttcatcacgagaggacattactaggcccttagcaagaccacgaggcatccagcagctgggctctggcctccctgttcctcactgcagggtgtcctggcggtaggctgtggggacagacacaccgtatatgtctgagctctgctctccatgggcacacgaccaggagcaaattgtccaatgtcagtgagctccagaagtgcctcccatgaacagaaaagacgctgtcaggcctctcgtgagtccaaaggcactgggctgtgcagggactggcacagggctgggagctggcaggtccctgaaacaggagctacgctgacacttccatgattggtcctgggctctgtccccgaccccgcctctcccccatgcagagctgagggcaggggtggagtagagagggctctcctccccctcggggtctctttctgttcctcctgatttaaagcggctcagccgtgcagccagtgtgacagctgtgctcctctgatgatgtcccctggacacgcacagcctgtggcgtctgagcagccctgtcaaccccaggtgaggatgtgagtcttcactcctccctggaggcagctgagtcgaggtggcaggtgccctctgcccaccagctcggccttctgcctctgctcacgtggcccggcagtcacagccctgatctgtcagctgtcggctgagttgtgcaaagctgccccacatggagggtgacagtcacaggagggaaagggcaaggcaggagcctgaaacccaaatgcaacagaatgagccctctcagcaggctgccactgagaagccaggaggtctccagggagcccaggaaggaggccagggagggaggcatgcagcccagactccccctgtttagccctgggcctcctatccagcctgggagaggcctctggtggcctcaccgctcaaggcccatcctgagcccatcccccacacatggctggagggttttgacaggcatctccctctccagcctggcaggagtctgaggctcttagcagaacccccaggccctccagggtccacttcctgttctgggcgccctgtgcagaggtgggaccaggtggagcacaggcactctgcaagccttgcctcaccttgaagggccgagcccacctgtccttcacagccctgttcaaagggcacctcatcctggaagccttccctgatgaccagcccctctgactccctgcagcccaagggcttggtctgtccctctcatcagtcacttgtcacccagggtgtatcatgacttctggttgtctatgtctaagcataattttcttatttagttctttggttttcttccacccttttattgttgaaattttcaaacctgtaggtgagtggaaaggattgtacaatgaacacaaacacatctctatccaccactgggattttacaatgaatgtttggccatgttcctttatctctcccaccccccctctctcttcatccatccaccttgaaaaaaaaaaaatgcttgcttgcaatacatagtcctaacacagcccagaatgtaatttgcaattatcctgtccatggagctttggggcagcactcagccctgcttagagtggccaagttgggctgaccaaggggcgcaggccacaggcccagttgctccctcccgggcacacactgagcctagtgtctggctggccagggctttttggaagcctgagtggggaagaagttgcctggcagcatcagatttggaagcagctgctgtcagccttagctgtgggagaggaccccaggcttgccctgaggggcccatgtctagttgctcagaacagggcaccaagttggcatttcctgctgtctctcacagcctcagtgcccccaccaggcccaggctcttccaagggcagcatagtatccatcaagtgggtgactacgagagccaggctggcaccttgagcaggaagagtaggccaggcccagctggctgatgtcagcagtcagcgttgagggccttggagtgaggtgggcctcggagctcctcatctgaggagcatggttccctaggtcccagccaggagctgacatggagaaacacaaacccactaaggcctgcatttcccattttccaagaaagctggaaatctagatatttgtggttaatgttcaggcttttaactgcaggctcccattttgaaagcctcagaaagcatgtcggtaggccaacttcacccacagcccgccttgaaggtgtgacactgcagaaaggcaggaagcagggttcacaggaagctttccttgggtgcatggaccgggggcgccccaagcatcagcagggattggaatgcgtggggcctgggccaggaggcaggggtggaggccaatgcccttggcagctgcagacctgcgggaaccctggctggctcctgggtccagccgtcacctgcatgtgtcccctgtggtctttgggtcagggcaggagctacagtggtggaaggacacactccttgagcctcaggatgggtgccctgtggtccttgctggttcaggaagagcagaatatgagaaatcacctgtagttctctggaatcacagctaaaacagggcttctgtgatggattcccttgagcagggtcctaggtggctcgcctgccccacctgagtcctggccctgatgctgtgggtgtcctgcctgccacaggcacacagaaagacagggaggagagacctcgaatgttcagcagccctgaaggaggcatccaggcctgggtgcccagctgaggcatgagacatggtgtcttcaggcagcattatggctccgcttacacctgacatcagggagggcctggctgagtgcacggcctgcacacctggggccgagggagcaccacagatttcagggcaggaataccactctgagcctgccctgtgcaaggaccaaggcctttcctgagcgtgttggttcaggaatggtagggagagggtccttgagtgtgcttaaggcccagctgcctcctcctggaccctcagtgacaccagatgaagatttgacctagtggacacatagatgttggttcagacacagctctttccttacaggagcctctgtgaattcggttttgggggtggatctccaggaatagggaggtcagaggggaggcagccccctactcttcctcactcagccttttgaatgttgtccttgcagaaccctaccatgtggttattcatggaaatggctttcagaatctaaagaaacgggatgaagttatttgcagatttatcttcaatgaaagcactatcattggtaagttgtctcctctgtgcctctgagtcacgtatttcccacacaatgctgcctttccccacagccagccaagcctcccagcccttgccaaccattccctgtggaccctgtggggttagaggccatgaggacaagtggaaggaggcactgggaaggccggtcacccctcccttcatctgccaagtggggaagtaacaaatccatctgtgcctcaagagcatcttacatcagggcttcccactcagtgaggctgggtttaggactgggtctgcgatcacagctgcatctgcccaccttagcctcagtttccccttcccttgagagcccaggacccaaagcccacaaggctacttctaggaaatggtggcagccccggagatctgagcctgaatggccaggtgcaccagtagcttgcccagaggggtatgtttaccttgcactgagggaggatgccagcctgtaggcctgggccttggaatcctggctcaggcacacattgcctgtgtcaccttgaccagatgagtgttctactctgagcctctattttctcaatttaacatggaggcaatatggtgctggctatgtatcctttaactgaaatgcttgggaccacagatattttagttttcagattttttcaggttttggaacgtgtgcagtatactgatgtttcagcatcccaaaccgcaaatttgaaatctgaaattctctaatgagcatttctttcgaacatcatgttggtgctcaagaaatgtcagattttgaaggattttgggtgtggattttcatgttatagatggtcagccacagttacacctaagtaagcaaaatcacatgcgtagagcagttggttcatggaagggctatagtattttttttaaatctcctattatttggcaatagttaggcatcagggaacctctgtgatggtggaatggcctgaggaagcgcatagtccaggcagacactgtgccctgggtgctgggggtggggtgtgctcttccccactgagggcctggggtgcagttggatttttgcatcctccttgatcttcccaggtggccccttgatacattcatttgatctgatgttagtatgttcactgaaatctaattccagggccatatggtaatcccaggatgacttctcttcccccaagaggcttcttgacctttttcctcctttccatgagtacataggaaggggctgagcctgtcatccccacattcccactcatcagcattgtgtggatggtctcagggaattcagttttcattgggttatactttcttggaactgtcttagggactgagcagcccctttctaaggaaagctaatgcttactgagcacttatatcagatatcgtgccaagtgccttatgcacactatctccttgaatcctcaaagcagccttacagaaagtctttgtatgtgtcaatcagaacaacagagagtttctctctaaaagaaaacagtatttattcaggaacggtgcccggcactgggaatgtgtgtgccatagtaatgtgcataatcagggaggtaaagaagacataggcttttaaaggagaaatgaagattagggaattgttttaagaccattactcttgcctaaaaagatcagttacaagggtgacactagtccaaggctggacaggcagttcttgggcacatgttcctgtagaagtatttttttgtgttaagtctgcaatggcttttgtgcaaggttgtggtttttgcaaagtcttttgtgatatttttgttatcaggcatataggcataaaaccctctctttgtagcctttcttagccctatttgtcatggattttattttattttttaacacaaatgactccattttaattctgacaactttctcatatggatggagagctagagagaagcatgatggaagagcctgcccagggccatacagtccatgttgcagggcaggaaagcagacccaggcgatctgccttctgcctccctgtggtggcagctcctgggaaagggggtacccagcctacctccgtgagtggcattcagctgcctcctctgtgggcctgtgggtgtactggcttcccaccctggagcttaccatctacatctccatacacaggccagcaccgacgtctcacagtggggagcccatgccacagctgtgagcacctgcgtagatggccattctgctcctggttgatggctggcccaagagtaaaaagaaacttattttttaaaataattgagaacaacctttaaacctattttcactaataggaagagatccccggaacatgtccctggagtgttggccaccactgaacacgcctcccctgcacccccaactagatggcagtgtgccttccctggcggctgatgccagcctggaggtgcagttcagggatctctgtcctgcatcagtccctgtagggcagcaggggcagagcctggttctggcttctggaagcgcctggatgcaatttttgacaactgaaataacaaacagagagagtgtctctaaacagaaatgctatttattcaggaacaggacattgcaatggaaaatacatgccagagtaaactatgtgcatatttagggaggtggaaaagaaaagcagagaaagccttttaaaggaaaatgaggaggatgccataattgttttgaaatcatccttggcaaaaaagtcaataccacgggttctgccagtcctaggttggctatgcagttaatgggccctgggaagccggggtcctggcagccgagcccagtgggtagagagctggagccaggccagcaggcagatgcagcagggcccacgccctctcccgcacttcaggaggtgtgaaaagggtgtgggctcaggagtgagaatgttccatgtctacacattaccgaactctcctgagcccaccacactcccacaaaaatgagtaaatagatacataaataaacaaaaattggaaaacaaaattacagacttgaaaaaaaaaacccagtcccctcctcaggcttcctcatcttggtaaatggtgtcgctgtccacccagttgttctggtcaaacactcaaatgtcatctttgactcctctgagcttcctcttcacatccatcccaccagcaagtcctgttgcctccatgtgcaaaatacatcctggatctgcccaacctggacagattcactgcacaagaaataaaaccccaacccctttccagggcccacaaggccctgccccctgtcctgggtcacctctttccctccttgacaaggtcagcgagtcactgcccagagcattggcacatgccactctctcagccccaagcacctttacctgggatctttgcctggctggctcctcatctttttaatctcagctggaatgtcacctcttcagagataatttatcattcatggaagtttgcaacactacacaaaataacaagaattgtgcaatgaacttaaagaagccatcacctactttcaataattctcaacctgcccccacctgctttccttggaacccttaccacagagtattttgaagcaaatccctggccttgcattatttcatgttcctctagaccagaaattgtggctctacaagataggagaagtcatgcataatgaagcggctgtcccttcctctctggttccctcacctcctctggtcatggacatcacagcacattgcactctctgtcatctgttttgtcctgttttttattttgttttctgtgtcccgtgcaatccctaaaggtgagtccttgagagcagggactctgcctgcctgttcctgttacacaacagagtgctgcacagggcctgggtgtggcgggtgcttgcaggggtctgtgcaataggaaggcagagcccacatgccggtcctgggccacagggtcagccctgcatgctgaggacagacatggggaggaacagtggacagacaggtgcactgacattcttctcatgtcattttcttttagatgaaaagccaaccagtatcgacaataattccatgaattgccctgggccaaaactagaaaaacctggagagtaagtgcccctggcaggaggctagagggcaagagaccagggagtcagggttgggcaccttgaggtgtacaaaatgtggatgccccccaccccctgctgggacagcacatatctgtggctgcgcaaagagcaccctcctccccacatcccttgttagtgacccccaaggtattcagggatctgcagcatcctagggtctgtgaggaaggcaggatgcaggagatgattgcccaaggaatggtacctttgctccaggttgcctctcagagttaagccaacacactctgtaaatacagaagagccaggatggtgacaccaagcagcagtccctggtcatttaggacgcggtcacaatggcatgagaccccatgcagggcccctcactgtctgacccacttaccctttggtcatcattgctaagtttacctgcaagtgtttggggaatgacctctcattacccatgctgtccaagggcaagaactgcatctctctggactggctctcaccatctgcattttctatgctttagggagtactctattgaagtcagcttgaacaaaggcaaaacattcttcaagagcaatgtcagcatcaccagcaccacatgtgtgagtaccagcatggggctgcaaacatgtatgaggactgtccagagcctctgcactagaaggagcacagaaaaggcagaccgttcccaggcagtcccagaaagtagcgtgtgcagcaggcacctgaggctgctccaacccggcttctggatggtgcaggtgggtgaggctgggaggctgtctgccaggagccagagtccagcacctctaggccaggacctcaggcccaggagccctggaggattccacacactgccgtcagggtatgtgtgtgctgctgaactggtgccccagctactgatctggtcctgaacctgctgatgaccctggcccctgagcctgcctggtggtcacttgctgtcatttcccagatgccttcagccccctttctgcctctcctccttgctcaggcccctgagatgtccctctctgctccctcgccaagccctgtagtatgtcccctcctgctgctgaaggggaggctctcaggcactcggacccgagctcagctccaagaggcccctgggaatggagatgctgtgccccaggtgcctgctcttcagagctccatgtctttgggcagtttggcccagggccgcataggcaggaggatgtgctggagggacgggcgggaggcctgagcccactccactgccttgtacccagtctcacttgtgaggacacaccagtgttgagagtcttccctctgggtctatccttgcctgtccctgcacatccatgcatggatctgcaggctgaatgcacgcattccccatcaggaatctacccactgatggcccaactgtgacagacacatcaggagcagccatggggctcccacctcgccagcggccttcatgctcagcctcagtggttcctctccttcagccagccgggttcccagcacaggcccctgccccttccctcccctcccctcccctcccctcctctccactcccctcccctcccctctccagccttctcttaagtagagctctggacatgaggaaggcctgagcagcctgccttcccacggatgccgcccaagattcctttattgcgaagaacacccagagaactgttcccgttgcttataccccatgtggccctggttctgagccaggacttggagctctctaaacctcacaagtgcccccagggagggcggctcattccctttgcacaggtgtggaggctgaggctcagagcagtgcgtggatgtgcccacggtgcagagcctggaagtggggagagaggctgtgggggatggacccgggtctcctgcccctgctcctgtgcctgcacctccaccctcacctgtctttgtaccggtagattttgtggtcctcacagaagccctgtgctgcaggcgaggtgtgcagtgagggtgggatcatcagaccatggaagcttccgggactttcttggcagggctctggggcagagactttcagcagggccagagaaagggtctatagctctctggggcccagccctggccgctggccccactgtagtacccggatgcggggccagctagggagagtgaggagtgggcagatgggccaccaagtggtgggcacggggaagaggccaccgaggccctcctatggtgctctctttctccaccagggcattttccgcaactggctctattttgtgccactcctgctgcttgtgccactgctgctgtgttgtgtctggcggctgtgccgcaagcaggcaagtgctccctgcccgcccagctctggggcccaggcacaggcccaccctctgagggactctaacatgtgactgccccccgtgatcccgcctgtgggaagtttccctcagctcccagctcatcacgtgagcccagggagtcgcagacctgtccacacgttcccagagcctagcaagcctgggcttctgcagggcctcctgccccgggctggccacagagagctggcctggaatgccctggacatggggttgaggcctgccctggctcctagagagaagtgaccccagaacccctgaaaccagggctgcctcaacaatccagacttctggaagcctcagatggacaagggccaggaggtggcctctgtgtggagggaggaagagaggggcccccatgaggccctgctggcccaaatggaggacgctgtaacccccagctgtctgtaccttgaggaaccagtgtggatctcggcacatgtctagttccttccccattccttcatctgtctttactgagctccagcttcccctgggccccatactgggctgggcagggacagaaatggtggctaccattccccacaggcagctcacagttctgtcctgtcatggctgagggtgaaatgtccaccccacaggagtgggaagggctccctgtaaggcggagcaggacccaaaagcagagatggagcccggggcagggaagatggaaggggtgctgggagctggggtggacggacccagctcagagagctgcagacagagaacagagcagaaggaggagagcgcagagctcagcccagggaacacacagggctcatgtctgcatagggagctgcaaggggaggaagcccgggactcagccatgaggctgggaggtcagggagggctcctgtagacagacaggctctccctaaggaagggaagtggggcgaacgctgtcttctccatgtggctgtgggcagagaaggacacttgtaggggctgggcctcactagggacctggtccctggcctggctgacccctaggaaccccacagcggcggtacaggggttcccctttggtaaggttggaggctgaggcccaggaggaggagcctgccgggtacaagttcacaggctcagggtggccagagtgacaccccaaaggcagtgctctgtcctggtgctccaggccagggtcccagctgtgtgcagggccaaggcagagcccgcccacccccatccagcctgtgtttgtctcttttgaacattctagactgtcaaggagccaccacctgtgcagaagccagaaaaggtaagttgcagttctggtcccgatattgtcacatcccaaggagcccactgaccttcaccaagagtgccatgaagcctgcgccccatgatctccatctgcttgagcagagaagttgacagaggggcagaatggagcctgagaagatgggggactcacagtgatgtccccagcatgccctttccgctccctgcaccccttaacataagccttgtcaccagttcgcagcctggggtggccagtttcagcaactgtgatgatctgtcctgaataaatggggctctctgtcaaggaccttttgtaagatgctaaggacagaggcgctctggaaaaggagccccgtgtttcagggacctggccctgtccccaggctctagaggcaggtgtggctccatttggcctctctggatccatgtctcctggcagggacgaggggctggctggggttagcctctcaggactgcagggctgagggatgggggagtcctggtgggcaccgagctgggaaggacaccagcccagtgagcacaggggccaggagtccgggaacaagttgtggctcacctgggtcggggacccaccccaggggccatgggcagtggtgagtagctgaggcaggaggccctgggcctgggatggggtgggaacaggcaaccctggccaagggtggcctctgcggtgctgcagagtggtctaggggaggctgcatctgcaaccaggtggatacggacagtcacctgcaaatgctgggaccattgcataacccccagggcaggcctctttcaacaagggcagccacgggagaaccaaggggacagagacaaagtcgttggcatttacgagaagagccatgtctgccaactaggaggagtttgcgtgtttttcacatgaaggaccctccactgtggtgtgggtttctttctggtcctttcattccccagacacacatctgggagtggccagcactgtgccctgccagcactgtgagcagacagttgtttttctttttttaggagccagagcaggaaaaaccaccatcaccaccaccaccgcctccgcctccaccacctccactcccgcctccgcccccagctcctgtaaacacctgccccactgtgattatttgttgctgtggatgccaaggagtgggcgggatgagaaggatagaggtgagaagggcacagtggagaggggctgtgaccccagcatgggactgtgggaggagggggcagatgggtcccactgtggagacctgggccctggaggaaggcaggctctacaggggctggactttggacacttgatgtcaagagcaaccagatgcccacctcaccctcgtgccccagtggcaggcatatatgagggctcctgtcccctgcaccaccgggtctgtccccacacattgaactccctctctagaaggatccatgtttctgtacagtggcagcttttgatgtctgaccagtccctggttcccacaggggtgcctcagctctggcagtggcccctggctttagaccacttgcctgcaggcgcatgagtcaagcaacctgagtcacaaaaggtcatgcagatcagaaaaaaaaatagaaatgaccagtcctgacacatgttctcaccaccacgaacactgcaaggatgccaggggcacctgccagcccgggcagcagaatcttcaggcagtgaggaaaagctgtcactgagtgggcttgtcgcctgctgagatgggctgacaggtgctgcagggaggggaggaggtggaggcctgaaagcgccctcacaagacacctgtgcaggagcttgagccccggagccaacacaacagccactctccctgaggaaacctccttcacgggcgggtccagggcccatcttgctgaggggaaccctgccagacagcagcaggggaccctgcacaggggtagagagggcgcctgggtggctggtgttgagggagagggaccccagagttcctacctggctctgcccctctcccccttggtcctggctctgtctgtggtcggatctcttgcttcctcctgggagggtcaggctcctctgcagcctcagtgggcatctggggaagccaggcctgtctctcctcagagtgtggggcacatgtctccagggggaggaagtcacctgccagcggcctgcactgccttgcaacacacggccctcatcccatccccaccggagcccagaaaggcctgactgcagcgccgagtggccaaggggctgcccgccgtgggtcctgggctgctttctggcctgtttttctctgccttcctcttctctcttccctggtgtcaggtacctactccctgagcagggcatggtcctctcacctgccttccccttgtgtgccccagcagcaaggctccttctccctgcccaggcccccatgctgggcccccaggcctaactcatgctccccttcaggacctctgctcagaaccacaggctcctcctgtctttggactttttatctgaatctgcccctggcgttttctcttccttcagcaaaatactgttttgttctagattccaaaactctctgtggccacagtgaccatgtccccagcacacaaggctgccaggcccctcccccagagggggatgggagctttgtctgggtgttttcctgggcacagagctgtggggggctggggagtcctgatgccttctggaggcagtgtccaagctgcatgtcttcctcatggccacgttgcttttcagggcaatctggataccttttgtgacctctctcacgcaagctgccaccaggtgccatggatgtgttgtcagagcagggaccaggtgagctagggcacagggacacagttgatggacaaaaggccactgcttttcccctgaccactgtcctctgggattggggctcagagagccatgtcaggcatctgcaaaagaggacggcacaagacacacagaaacggtgcccatgggcatcccagccagtttctggacatggcatcaaagctcttcctttgttcatcacctggggccaggagtgctggctaggatggctaacagagttgttgggcaacagtgactggttctaacagggaataaggattccttccttggttcattgccttgggaccatagggaggaccaaatttttaagattttctctttgtaacttattatgaatgaagactaataattatataattattaatgaggcctcagtaatgtacgcagtcctcccatgggccatttgttaggctaagccatgctttcactgtttttatcctcccagtaactgtaccagtaggtgctattattatccagtttggtgaaggggacaaaagtgctgagatattaagtagcatgtccctgctcctaaagcccacgagtgatagggctggatgtgaactgggctgactcctgcccttactctgcactgctctccttttggatcagcaccaaggggcttctctgcttaggccctggggccctggagagccctgcttctggctcggcctgggactcatctgcctgtgcctcccacagtccagccctttgcacctggaagatgatttcatcaccagggtttatagagggacctgcactggccagacctcctgcatcaggccagcataggttctcagtggccaggtggctgtgcatggacaaggccttgcaggctgcaagcctctggatgctgctgataagaaatgggccgggagcccctgggaggcgtgctgacacctggcagggcactgctggtgtcagaggcatgcagggctcctccagccgctgggctcctggctctgtgcctctgcacagggctctcaatcccagccatgcttgcacagaagcccactttccatccgaggtcccataaggcctctccacgttgctacagcccagttccggtcacatggcactagtccagccttatgcactgaacaggtgagacacttaggagggatagagcttgacggccgagtgtgaaaacaggcacctcaagcagaggaaaggcaagaggtgggaaggttggcgtgggaaagggccagaaatggccttactgtccagtgtggtgagacaggggatggagcaagtcgctgaaattgtctcattcccaagggcagctctttgaagctaaggtttaggggtggggtggtggggggcagagtaattgcattacagagggcacttaccactgctcagggctctgccaggcccttgccactgtcatcatgtgaagtccaccttgcgattcttggaaaaggagagacaatccctgttttactaatggcaaaatagaggcccagagtggcccagagagttgcctaaggccacccagatagtaagtggctgcctccaggctatcagaaatcaaccccagatctgtccctaacccagggaggcccatagctgtggcttgtagacctaggctcctttctagctcttctgcgacaacctaatttgaccttgtgcttcccaactatagtcctgaacacccgactgagtgtcttgtaagatttctgtcggatacccaagaattcagacaatctggcaggagttccccgttctcctctttaagccttcggtgtgctggccctagggtctaacatgaatcatgcactaaagaggatgcatccccttaagaccttcagcccgtttcagagccacagggtcagactgtaagcctagtcatgagtgtacagagccagacaccagccaggctgctggtgagctcagcagcttcctgctcagagacactgggaatgtgaccttcctgcctgagccaggggtccctgagtgagaagcagccctgaggctggaggagagagagtgcatctcagtgagaacccgctggagaccaggcttggatgggtggctcggccccagccaggcagcccaactgcaaccgcacggctgtggaggcatcagtgagacgtcctgccaggacaggcataggctgtctgtctcttcactgcagagtgaagaggccacctgtgtgctgcacacccctcttccaggatctcccctcagacagggattcactcaggccctcagcaggttgggggatcctgacagaaccagtgcatgcctctttctccacccatgcccggccttgtgaggaggctatttccaaactcttcttcctgacttggcattgtgggctgacctggggagtgtgataagctcgggaagttgatgagcctgtttgactggaatgtgctgtcgaatttagaggagctgctgccttttaaaaccttgtttagtttattgtttcagcaaatccaaacatttttgcattttggcacataataatgcaggaaattctccaaggctcagtttaccaaaaacctcagcatttttgtggcaaaagcagtcagtcttgtttaatttcaatttttgttttaaattgagtgtgtctccctgctccatcaccttcagttccctgaataaattttttgatagtgtcctcttccaggccatccccactacacacttatacaaaatgaagcagcacaactccgagtctcttgagccaaactctacctcccatccatgctgaggattctccttcaccttatcctgtggatactcattatgttaatgggaaacaatatcactcgatccatcaggaaagtcaggctaatagtgtgaaaccttactctctgtcaccaaatatagtgcccacaatgatataacagcctttccagtgagtttaattcgtgtgcgcaccacagcaggaggccctttagaaactggatctcatttcattctcacaacacccaggaaggctcatagctgccattcatatagatcttaaggtgggccagacactgttgcaactacattccacaaactaatatatgccataactctattgtggggaggaagctagaggccctacaaagttaggtaacccacccagggtcacacagccaggaagcaataggaccagcatccaacaacctggctccaggtccttactgtgtgcatggccacctctctgtcctgcaaggtagtcactactgtctgcatttcagagctgtggacaccgaagctctgatgtttagtgatgggctcaacatggcagggttgttgagtggtagagccgggttatgaactgacctgaggggaggctcatgtctgagtcaggttccaccccatgtcctgctgtcagagtgatctatggaacacctgcaagtgcatctctctacagtgcaaaatgtcacacggcaggtcctcaaataacgtttcattcaacgtcatctgaacaccgagtgagaaatgatgatgctgatcagaaaaaaatccattcccagctgaggccaatgtctgtgtggagtttgcatgttgttgctatggctgcagggaatttttctgggtacttcagtttctgcttacatcccagagatgtgcacatcaggtggattggcgtgtctctatgggtgctgtgtgagtgtgtgggcatgtgagtgcacactgcaaggacatgacatcctgtccagggttagttcccaccttgcaccctgagctgctgggataggctccagcctcctgcgaccctaagctggaataactgagtaaataattatgttatttgcttttattaacttttcttaaaggtgtgtatagctcacatttatttcaatgtttaatattagaagcattttggtttttatttagaagtttgatgatgccttcatgactagatatatgccacaggaccttaatttactaatatcaattaatctatgatccagtctgttttcttgtacactgtttcactggaagtcatgatttccaagaaactatcaacagcttctaatgagaatttactgaaatttacacatgatacatttgtgaatattaatatcttgatttcacactgtcacttgcagacctccttctaaattcgtactcatgtttgctgggatagttgttctgggtaacaattggagcttaatgcagacgggccttaggatgcattcatgaccatggagctcctgagttctcctcctggccatatgcccgtggagggcactagaccaagggacaggggtggcaaagccaggctggctgtggcctccaactgtccaggaatcccagcttgcagctgttcttgaagccagtgctttttgggaaagtttcagatcataactttggtattgcaattacagagagccttcccttcgactcctcagcaccacccctccaaccccaaaacacatgcacacacacacacacacatttctgtaacataatcgggaaatacaaagattgagccaaaactccaaagcactggcaattaaggtttctgattgtttgccaatcacttcaggaaatgtccctttaccttagagtggttgagctgatgtgagaagtaattagttgctggcttagatatctgcaatcagtagagaggcagtgaggaaggagaccctctcaaactccaggaacctcctcaccaccttacacttaccccacagattcagggggcagccacctggaggtctcctctactgtgaggcaccccaaccctgctcctcttcatcagtgcaagtgtagacccatacctcagagctccctggatctcctgggatagactggggcagaggaggggaggtggcctcagtgttagtgcccggggtcctgctccggaggatccctcagcagtgggtaaacactaggtctggaatgattgtggtaagtttttactggaatgttttgcaataaataagtagaaacaaaggaggtggaaataaacatgaaagattcctttctctttacaatagcaataaaaaacaaaatacccatatataagtgtaacacaaatatgctgacccatgatgaaaagaaactataaaactttacttattggtacaagagaaatttgaaaatataagaatctagagcacaatgtcaacttttcccagaggaattcatgagcttgctatgttattttagtgaaaattgtaatgaaacatttttagggaatttgatcaaaacgacaagttcactcgaaaaaaatagacagttaagaatcattaagaaatttttaatacagaaaagcagtgagagaagacttgccttatccaatgttaaacattaagctccaaaaattaaaataatgaaaaacaagaggctgacaaaataatggccccaaatcgagcaaacaataaatagagtatataattgtggtgatagcccctggtactgacagtgtgtatgcaggtgagctcaagtgcacttatggatgtttaaggattgtttaacatatgtcaaaagaaaaacatcaggcaaattaaatgtaacggagttgaattgagcagaaaaaacaaaacatgattccaaatagggcagccctcagaatcaggacagactcagagagtttccagggctaccacagggtcagataagattttggaacagaaaagggaaaacgacatagagaaaacggaactgaggtacagaaacagctgaattggcaacagctctgtgtgtcctcatttcaacagttggctgctgtgagtggctgaagtgtggctgctgtgaatggccaaggctcagctcccattatagaagtatactccgcagttgggttttcagtttgtttatgtactgagttaggctgtggttcatatgtgagaactcaagtatgtgagtatggaggctttctcaggccaaaatttagttttatttaacaatttcactcttttcagtggcctctcaatttggggaggttgaccaaaactttgggcattgatgccactctctgtcaccatcaaaaatgagttacttgatctcagtatggaattcacaagtcacaacatcatgccacttcaatacttttgtatgctcttgctgacttagtagaagtgagaccacttatgctcaatggatggttgcatacaacacatcgaagattttagagggttcagtggaccacggggactattaggatgactacaaagaggatgatatcaaaagaccaaagtgaactccttaacaatgtttcttatgaagcatactgacccaaatcaatcaagtcaaggttcaggcagtctaggcagctcaacagtgtttaagttgattagtcatagtctttgttcagggtgtacaggccataattcactgtaaaatggcctgatttgtagaggcattcatctttgttgttagcctggtaacacaagcatgatagcctggaaagtcgctagaataaatataaagattagaaaacccaagtttgtcatccaccatttaggatgcctgcaaaccaactgtcagttgctcccataaacacattatgtgttcctttctcttgagagattttcttaatgtatttggtggcagagtctaagaaaacagtaataccagccagccaccttttaaattaaactttctgtagtaacaaaatcagaggagagataggtgtaacattcacttgtgttcaataccaaacacaagccctcaactgtagcaaaaaggagatgtgaagctgcatgatgttccatgtgaatgtatatgtcatcacctctcttttggagtatggcttttactcatggttcacatctggctatttgatatggctaactcctgcctttcaaataccttcccatgaaagttcccatgataggtcctgtgatcagaagcaaaaacagtcaataactgaagttagcaccaactttgaaacagacaaagagaagctagtttctactgagtaaagatttcagttggtttcctgggggctcactcttgctggtagtggggaacccactgtatgaaatttagagctaatcattaaattgggaaaattcttaaattttgtagccagacagacctcccaggagttcagcataatggaataagcacattctctactgacccaatataggcccttaggggttggagaagtgtccatttagttgtatttgagcaagggtttgttacaattgttcacccatggccgggtgcagtgactcactcctgtaatcccaacactttgggaggcctaggtgggcatattgcttgagtccaggagtttgagaccagcctggccaacatggcaaaaccccatctctactaaaaatacaaaaattatctgggtgtggtggcacatgcctgtaattccagcttcttgggagactgaggcatgagaattacttgaacccaggaggcagaggttgcagtgaaccaagatcatgccactgcactccagcatggggtacacagggagtctttgtctcaaaaaaaaaattgtttgcccatcagtctgcataaaaggaagtttgcttttttgtacctcccttataatatgttgtaaaggtatataaccacatttagtttttaaaaagtaccctactgaatttaatctggtgacattatacaagcaattacttgtacccacgtagataattcccaggtcttgagagactagtgcctggaagccaaatataccttttgcaggtatcacttgaataggttttgtatatttggtaacaatcaggttattaattggaaatgttagagtgttgtttctagcaagtgcaggaaagaaagtagcaattatgtttagtgtatcaaggacaactttccactcatcctttggagtttcaaggtgattctctttgggaacgtagacactggcattaatggaattgtttcttcatttttttggttttagcccacaaacccaattgctcgggttttatgctggagcagaagcttgagctaaagccatccactgattatggtcccatgaattttcctgtagagaaaaggaaaggattaggacagcaggagatgaggggaaaagacaaaaacttaagttttccatgatgtcagagaaatcttaatttatgatctttgaaaagttgtccatttctaggatgttgtctgcttctggggagaaatttctctcatcaggtttacctgaaagtctgcaatatatatacagtcccaagagtctgaaggggcctttctgagttgtgaaatgcagacccaaggtccaaggccctgaagcctcactgcagtgtgggtggtgacaaggactcggtatggtcccttccaatgaggttcaaagcaattttcctctgacataatttccagaagacccaagctacagattctacaccatgaaaggtttgattatcctcagtcagtgcatcataaaaagcttcctttacctggtgagaatacactttgacataatgcattaaagccttccaagtttaagcatatcagagtttaggagagtgggagaggcatgcggttctgttactaggggcatatgctttccagtgactatttcgtaaggtatcaacttatgttttccagtaggagcgtatctgattatcatcaaagccaatgatagtacctttggccaaggcaacccaattgactcagttaactttgtcaatttgagttttaagatgtcatttgttctttcaacttttccagaagacagagggctaaggacaatgatagtgccatcatgtccataatatcttaagtgctttataacttgcacagtaaaatgagtttccttattgctggagatttctccagcgagtcgccagaaggaaacacattttctgataatttcttggctattgtcattgaatcagctttcccacatgggaaagcctttactcaaccagaaaacatacaaactgctacagggacatactgataccccgttgaggttggcaactgaaggaagtccatctgtaagtgtccaaaaggaaggtggatcacaaggtcaggagtttgagaccagcctggccatatggtgaaaccccatctccattaaaaatataaaaaattagccaggtgtggtggcgtatgcctgtagtcccagctacttgggaggctgaggcaggagaatcacttgaacctgggaggcagaggttgcagtgagccgagattgcaccactgcactccagcctgggtgacaaagtgagactccatctcaaaaaaaaaaaaaaaagaaattgcccatcaagtggtgaaaatatactacctgaagtttttattgttttcccaggattatgagtttgataaaccaaacattgattataaaccattttagcaactttgaaacagtcatcccaccagtatttcttcataacatggattctgtttcaggacaagttgtgggatgcagagcttttaatagtagaagcttcaaagactcaggaagggccaggcagccatctgagccctctgtgagtctatgcttaacattgaatttacatcctttagataccaaatttgtttttccaaatcaagtgcattgcagtgtttactgagtaggtcatcatgagagaattgacttggatcaatcttatggagttaatttaaatcgtatatcctaatagtttcagcactagctgatttggcataaataccttctagagcattccttttatattcaggttcagttttacaggtatgagcttcaatcttaataatggccatctctgatggtaaccaggtagcagaaaggagtttatctatttggagtccgtttatttaatgaggatcccactagaagtaagaaaccctttgttgtttccataaatgccaaaattgtgtactactccaaaagtatgtcttctatttgtgtaaatatttactgacttgtccttagctataggacagacttgggtgagagcaaaaagcctgtggtttgagctgacttaagttgaggaagaattccctcctctattagctcattttgggtggtaatggcatatcctgcctgatattttcttttgagtttttggcataggacctatgaacaaaaaaataataactcaggattagccaatgtactgtctcgtaaattaacgcaagaggccactatttccaatactgcacttacacaattgtggtcatcaccagagtcaggaagagttaatacaatagcagcgttaagtaggttgcagcattttagatggagattagaagacatcgggaagaatttcataagatgctagatggcttgctgaaaaatgctgtgtttggttgaaacttaatagacttttcacagcatgttggacttgtgaattgagttcattccctaaaacaagctcggatgaagcttccaacttggctgctgctacatctgcttttaaatgattagaatattccctaactactgggtctaattgcagactggaatatgcagtgggcctatgtttcccccatgttcttgagtaggaacttctaatacctgattgttgtgttcatgaacaaccaaggtaaaaggtttagtgtagtttggaagtcctaaagctggaggctgtcataaggccagtttcatggttaaaagcctggactgtctttccgaggtaaagattcccatactgcatttctagtgagctaaaacaatggtgaggcaattaagggaaaatttgcaacccaggatcctcaatatcctgtgagtccaagaaaacctcttaaatgtcttttggttccaggccaaggaaaatgttgaatagttttgaattctcccaggtgaaagggaaatcccttcagcagtcaagtcatgtcccaaatagtgaaatatttctcttgaaaattgaagtttttccatcaaggccttgtgacctttatgtgtgagttgctatagaaggtaaattgagccaatttcagagcactgttgagtgggagagcataacaggtaatctacatactgagtaacagtagaatgtccagaagactgtagggttattaagtactgaggcaatgcctgggaaaaatagaaaaggccaggtgtactgctgatttttctgagtaaaagcaaacaaatgttgactctctttatgaaccggaatgttaaagaaggctgagcagaggtctattaccatgaaccactttaaatcagtgggtacgttaggtaataaagtatttgaattttggactatgggaaatcttggtattataatcttattaattagctgtagatcttgaacaaatcttcaacctcatccatttggctttttaactggtaggatggaagtgttaacaaggactggtacatggaattctaaatcctagtttagttaaatctcctacaattgttgagagccctttaatttcattaggttttagcgtatattggagtaatttaggaaagacttagaataaccagtttggacctttatagacgccgcacttttaattatttctgtatcatttgaggaagagacccataaatattcaggtgttttagaaaggtgtttcattatgggcctgagttttgatcttatcgatttgtctgtagagagcataaccattctggttcaggagagtcaggaaactctacgattgcttctccctctgaggagaattgtatgtgtcctttcaactctgaaagtcctaccctggcaagtttactggatcactgttacatagtagaaaggtatattttcttgcaaatatcctcaagttgattaggcgggttcagatatggaagcctcttgaacttgattcaaaaccctcaccacagagatgatcctttcacgccaagagatttgttggctttttaaagtagggtttatgctggataaggcgaccctggtatacaccagcattgcacaggattcccagcttacatcttgtttttctatgtttatttaagggtgttttggggagagtttactagagaatccctgagccctgtctatgtttattattctgagcattaaaatctcttgggtcccctctagtggtgaaccagtccagcctaaagggaggagccttggtggtagactgagacaaaagtcaacaatctcctttcccagtgtcctgggtgtttgcaatgaaggcatctaccttggggtaaggaattccttattctgcacctcttgcttgtgatttaaaataaaaatgagaaggtccctttggtcttggcccctgtaactggtgtaattggagaggcataagattgttagccttttgggttttttcttgctctagagtcttctcaaaatgttcagctaaggccaccaattcagtcatgtctgtaactttccatcctggcttatgggttttaattgaactgccaagttcaggacggagctcatttgtaaatacagcagttaatgccattccagtctctgaaggaaatactccttgctatattttgagcacaaaatatttcagaaacagtgtttctaagcaagttctgtaatctgaaactggttcctcctgctttggtctgcagggttggatgatgcaccaatcaattttttctggaacaatcttaggaactgaatgtaaaatgtgttcagcattttctctagctccttttacctcttctcatgcaggggtttttgagggtctttaatatcctcctcaggtccaccccattctgctgctgccatccatttcttagcttcaccaggccccaatattatgtgaataaattggttaaggtcagggagccattcgaaattcctcagtaaacccttgagccttcacccttgggttagggaagtcctttacagtggctctaagctcagttttaggccatggagtaaaggtatttatcacaggaaggcctggctgatcagaaggtctttctttgtaaggcatctgggttttttttttttttcatcttcatgctaaaagggttatttattaaaaatgttagtggactcatagtatgtgagtagagatggataaaaagaggaatagctgtgagtagagatggataaaaggaaggaacaggggctgggcagggtgactcacccctgccctcacccagcactggtgttagggatgatggaaggcagggagaaatgagtggacagcagtcagcaggcccctgagccccacagctggcacttcctcctcccacaaaaatgaacggaggcagcccctcacaacatccccacagatccctcaggctgggtggcagtgccaggaggaggggccaactccttctgggagtggcattatcctttctggttcccgccatgccttctaaccatgccagaagagggtttgagcacaatggccttggctgcccctagggattgctcagaggaaaaaaggttgggggctgaggcctgagtggacagaggagagcactgaccagaagccaagatcttgcctgggccttatagtctgggtggtgcccaggaggagtgaggtggggcttcaagcccccatgacaaagccacctctgtgaggcctggactgtggtccagcacatcctgatggagtgacctgcactctgggtccagtcggcttgtggtcaggagggcagtggtgggtggaatacagtgctgaaccttcttgagccccaaggaaacgtggagaaaacatccgtgttcctccaggtggaggtctgggccaagcccatagactctctggtcgctcttgctctgggtacggccttgagctttgtgtgtgacctggggcaggcagggtgagggtgctgttatgtgaagggaccccaactctgtgctgcaaggagagagacaggctgtctggagaaagagaaagagattcagctctagtgctctggggctttgggaccaggatgctccccttcaaggaaggcagcttgtcagaggcagcaccagagctgaggctcaggatggctgggcttgggcgtgcaacatggagaggtgaggagcagagccctcaagaggagcgagggagggtgccagggcatggccagctcttctagtagctgggctgtgattgcctgaaggcagggtatggagaccccaggaacctggcaggggacggtctggcgtgcaggctgggtggagggactggatcctgccagcagtgcagagcttctctggagggtgtgagctgggagggaagatggtcctgggaggactagatttggggatgggtggagtcagggagagcaggctaacacacttggattgtactaagaaggaagcctgaatccctgaacaggtggcaggagcccaatcgggcatgaaggagggtggacaggcagctgcagacacaggtggctcaggacagggtctgagggggcacaaggggaaagtcagcatcatcctggatggggactagcagggcaggggcaggagagggcaggtcacaggacggggcctagatgggagaagggcccctctcagtaagagagagaccatctctgtaggggaatccagcatttgaggcatttgtcactcacatgcccaaggggaggctttctgcatgaatgacaggttcaagcaagctcaaagtctgcatggtctgtggaacacctgtgaggaatggagcgtttccttgggaccatcaggctgagactggcctggcaggagacccctgggattccaggcagccgggaagggtggccttgagtacagaaggagcagaacaggccccacgccagggaaaccacaagcattgatgggctgctgctcctgccctggtatgtgggcatcatcagcgccacatcacagatggggaggtcgaggcaaagtagcatatgcccactggcatcctgggatcctgctgcagccctccagccacaggtgctgaaggggatgcagttacagtcctcatgcttgcagagcagggacaggcacatctagaaggacagggcacttcccacaatgggctcagctttctgccaggacatgactggaaataccaagcagggtggtcactttagctgggagcaaggataaggggcttcctggaggaggccactctggagctgagtctgaaaaggtgagcagcagttcactgggcagacaaggttaggaagaacattcctgaaacagaggacagcctatacaaattgagaaatgggagagctgagcagctctgagaaagattgttatctaattgcctgcctgctaagccccaagagaacagccttggggaaacctaacaattctccttgaaaaggccaggctttcaatttgctttcatgcttataagatggcttctggagctccagccatcacactcatattacaggcaggaagaagaaggaaaaagggaaagcagccttctttaaagcaatgtccaacaattcctatttatactccattgccagaatgcattcacatggccatgttgctcagcaagggagactgggaaaaggtcattttacaactgagcacattgcctctctctttttttttttaattttaagttccgggatacatgtgcaggatgtgcaggtttgttacatcggtaaatatgtgccgtggtggtttgttgcaccacattgcctttcttaacaaaagcaggcttcgttagtaaggaagacaggaagaatggacttggggtgaccaatctgtgtttggtattgctgggcccatttaagagatgggaaagccattcccaagaggttgagtgacttgcctgaggtcagaggctagattgaaccccagtccctttgaccttacttatagtgaccctgagggcctttttgaaaggccctgatcaagtcttcagacagggttgccccgatcatgagcataagaagccagcagagagaaaggcatcacagatgaacacaaagacaatctctgtgtggcttgcagctgtgtgggtggtgcctggctacactagtgtgtgcccaagatgaaagcaaagcagctgcttctgcaaaacagagtttgctcttcctacgggtctggatcatcctcttcccaaaccaagggaaccgtggagctgctgccttctcagctcatcacccacccaagggtccctggagccagccttgagggctgtggtgagcactcatcccttccacatgctcactagagccttctgtgccatgctggggcacagaggtaattggggcctcctcctagctaccagggggaagcaaacaatttcgactggagggctgagggagtccagagtcagagacccaaggctgcctggagaggaagaggggactttgaacgctggagctgagtctggaaggaggagtccaggctggaggcagcaccaaggggagagaggaggagcacagcaaggcccaccctgtgggtcccgatgggtcctggccccatccctttgagccaggcaaccgcagccttctgagcccagttcgaatgccatcacggtgaccttctctctcttctcttccctacaggggaggtacctcagcttagcccttgcacagtcccaatatgcacaggctccctgctgcccaaggatctgctttccacacagccaggagtgcctttccctaccacaggctccctgcagcccaaggatgtgcctgagacacagccgggagtgcctcgccctcaaacaggctcgctgcagcccaaacatctgcctgagacacagccaacacagcagggagtgccttgcccgcaaacaggctccctgcagcccaaggatctgcctgagacacagcccggagtacttttcccaagcacagactctgtgcaacccaaagagctgccttcaacccagccgggagtgcctccccctcacctgctcctccaggtgccgcctccccccagctaggtgcttgaggcctccctccaggatgctgccgctgctgtccccactgctcaggcacacggcagaaccccctttgtcactccccccgtcagagcccaacttctaaggcaccaaacacccaagattaacaggcttttgttgctgaactggacatatacattgagtcttttcttgcggtcaaaggagttgaattcttgctgatcaactaaagttgattgtgtttgacaccagggagcttgtcttttgagtgagctggatttatactgcacctgccacgacacagtgccctggtgccgtcgggatgccaggcatggatgcattccactcccaacagccccgaattcatctgtcatcaagggctgggacacatgaggtcttaggccaaattctccatttaaaaagctcaaaaagtgtttgaaatatgaattcaatactgtgtatccctgcctagctttttgttgttgttattgttgttgttgttattgtttgagacagagtctcgctctgtcgcccaggcccaggctgggtgcaatggtgtgatctcaactcacggaaaactccacgttctgggttcaagtgattctcctgcctcagcctcccgagtagttgggattacaggagcctgccaccatgcctggctaatttttgtatttttagtaaaaatggggtttcaccatgttggtcaggctggtctcaaattcctgacctcaggtgatccacccacctcggcctcccaaagtgttgggattacaggcgtgagccacagcacccggcccctccctagctttttgaaaggaaaaatacttgcatatctcacttcctgtactcatcttcttgtccctggtttccattttttggctactcaaattctgaatgtgtcccagaaggcagtgaggccctttctggaaatgctaattatcttcccagataccccacaccatccccaagaccaggcaaatttcagggaatcctcctcatttcacgagaaaaggtaaacttccctccttaatcatttgtccccatagaagaaaccacagccccaacagagatgagtgtcaacaggcagtgtcccaccgcccactgtggcacatggtggctgcatgactgcccaaggtgccacccacacaggccatgggcaccccacatggggctcctgagcaagtcaggagaggggagctatggctgaggttgtccagtcatccctaatccatctttgagagtaaataaacggctctccacctcccccatctactggaatgcaatattgatgcttttccacagaaattctgaaagacaagtacaagttaaaaatat
